(12) United States Patent
Mattner et al.

(10) Patent No.: US 7,528,223 B2
(45) Date of Patent: May 5, 2009

(54) ANTIGENS ENCODED BY ALTERNATIVE READING FRAMES FROM PATHOGENIC VIRUSES

(75) Inventors: Frank Mattner, Vienna (AT); Walter Schmidt, Vienna (AT); Andre Habel, Vienna (AT)

(73) Assignee: Intercell AG, Vienna (AT)

( * ) Notice: Subject to any disclaimer, the term of this patent is extended or adjusted under 35 U.S.C. 154(b) by 384 days.

(21) Appl. No.: 10/512,790

(22) PCT Filed: Jul. 24, 2003

(86) PCT No.: PCT/EP03/08112

§ 371 (c)(1),
(2), (4) Date: Oct. 27, 2004

(87) PCT Pub. No.: WO2004/011650

PCT Pub. Date: Feb. 5, 2004

(65) Prior Publication Data

US 2007/0134262 A1    Jun. 14, 2007

(30) Foreign Application Priority Data

Jul. 24, 2002   (AT)   .............................. A 1124/2002
Jul. 11, 2003   (EP)   .................................. 03450171

(51) Int. Cl.
  *C07K 5/00*    (2006.01)
  *A61K 39/145*  (2006.01)
  *A61K 39/00*   (2006.01)
(52) U.S. Cl. .................. 530/300; 424/209.1; 424/184.1
(58) Field of Classification Search ........................ None
See application file for complete search history.

(56) References Cited

U.S. PATENT DOCUMENTS

| 5,663,153 | A | 9/1997 | Hutcherson et al. ............ 514/44 |
| 5,723,335 | A | 3/1998 | Hutcherson et al. ........ 435/7.24 |
| 6,037,135 | A | 3/2000 | Kubo et al. ................ 435/7.24 |
| 6,083,703 | A | * 7/2000 | Wang et al. .................... 435/6 |
| 6,150,087 | A | 11/2000 | Chien ............................. 435/5 |
| 6,413,517 | B1 | 7/2002 | Sette et al. ................ 424/185.1 |
| 2003/0162738 | A1 | 8/2003 | Egyed et al. .................... 514/44 |

FOREIGN PATENT DOCUMENTS

| AT | A 1973/2000 | 11/2000 |
| AT | A 805/2001 | 5/2001 |
| EP | 0 468 520 | 7/1991 |
| WO | WO 92/03458 | 3/1992 |
| WO | WO 93/00365 | 1/1993 |
| WO | WO 94/20127 | 9/1994 |
| WO | WO 94/25601 | 11/1994 |
| WO | WO 95/12766 | 5/1995 |
| WO | WO 95/22317 | 8/1995 |
| WO | WO 95/25122 | 9/1995 |
| WO | WO 95/27733 | 10/1995 |
| WO | WO 95/27901 | 10/1995 |
| WO | WO 96/02555 | 2/1996 |
| WO | WO 97/30721 | 8/1997 |
| WO | WO 98/15287 | 4/1998 |
| WO | WO 98/16247 | 4/1998 |
| WO | WO 98/18810 | 5/1998 |
| WO | WO 98/37919 | 9/1998 |
| WO | WO 98/40100 | 9/1998 |
| WO | WO 98/52581 | 11/1998 |
| WO | WO 98/52962 | 11/1998 |
| WO | WO 99/15259 | 4/1999 |
| WO | WO 99/33488 | 6/1999 |
| WO | WO 99/38528 | 8/1999 |
| WO | WO 99/51259 | 10/1999 |
| WO | WO 99/56755 | 11/1999 |
| WO | WO 99/63941 | 12/1999 |
| WO | WO 00/11186 | 3/2000 |
| WO | WO 00/23105 | 4/2000 |
| WO | WO 00/31542 | 6/2000 |
| WO | WO 00/44775 | 8/2000 |
| WO | WO 01/17551 | 3/2001 |
| WO | WO 01/21189 | 3/2001 |
| WO | WO 01/24822 | 4/2001 |
| WO | WO 01/54719 | 8/2001 |
| WO | WO 01/72782 | 10/2001 |
| WO | WO 01/78767 | 10/2001 |
| WO | WO 01/24822 | * 12/2001 |
| WO | WO 01/93903 | 12/2001 |
| WO | WO 01/93905 | 12/2001 |
| WO | WO 02/13857 | * 2/2002 |
| WO | WO 02/32451 | 4/2002 |
| WO | WO 02/33127 | 4/2002 |
| WO | WO 02/053185 | 7/2002 |
| WO | WO 02/095027 | * 11/2002 |
| WO | WO 03/047602 | 6/2003 |
| WO | WO 03/073097 | 9/2003 |
| WO | WO 2004/014936 | 2/2004 |
| WO | WO 2004/024182 | 3/2004 |

OTHER PUBLICATIONS

Walewski et al, RNA, 2001, vol. 7, p. 710-721.*
Bullock et al., Journal of Experimental Medicine, 1997, vol. 186, p. 1051-1058, in IDS of Oct. 16, 2006.*
Parker et al. Journal of Immunology, 1992, vol. 149, p. 2580-3587 in IDS of Oct. 16, 2006.*
Mayrand et al., Journal of Immunology, 1998, vol. 160, p. 39-50, in IDS of Oct. 16, 2006.*
van Rompuy et al., 1981, NCBI Accession No. NP_040982, 1981, p. 1-2.*

(Continued)

*Primary Examiner*—Bruce Campell
*Assistant Examiner*—Agnieszka Boesen
(74) *Attorney, Agent, or Firm*—Fulbright & Jaworski LLP

(57) ABSTRACT

The invention discloses polypeptides encoded by an alternative reading frame of a pathogenic virus, which polypeptides—start with a methionine amino acid residue,—comprise an antigenic determinant and—comprise more than 7 amino acid residues and fragments of said polypeptides comprising more than 7 amino acids.

41 Claims, 4 Drawing Sheets

OTHER PUBLICATIONS

Parker, Background on the HLA Peptide Motif Searches, 2007, p. 1-5, website: bimas.cit.nih.gov/molbio/hla_bind/.*

Boesen et al. Clinical and Diagnostic Laboratory Immunology, 2005, vol. 12, p. 1223-1230.*

Sidney et al. Human Immunology, 2001, vol. 62, p. 1200-1216.*

Southwood et al. Journal of Immunology, 1998, vol. 160, p. 3363-3373.*

Machuca et al. Intervirology 1998, vol. 42, p. 37-42.*

Vaccine Concepts/Designs, NIAID Division of AIDS, 2003, p. 1-6.*

Potter et al. PSTT, 1999, vol. 2, p. 402-408.*

Price et al. J. Exp. Med. 2008, vol. 191, p. 1853-1867.*

Anthony et al., "Comprehensive determinant mapping of the hepatitis C-specific CD8 cell repertoire reveals unpredicted immune hierarchy," *Clinical Immunology*, 103(3):264-276, 2002.

Bitmansour et al., "Clonotypic structure of the human CD4+ memory T cell response to cytomegalovirus," *J Immunol*, 167:1151-1163, 2001.

Britt and Alford, "Cytomegalovirus," In: *Fields Virology* by Fields et al. eds., Livincott-Raven, 2493-2523 1999.

Bullock et al. "Initiation codon scanthrough verses termination codon readthrough demonstrates strong potential for MHC class I restricted cryptic epitope expression," *Journal of Experimental Medicine*, 186:1051-1058, 1997.

Chen et al., A novel influenza A virus mitochondrial protein that induces cell death,: *Nature Medicine*, 7:1306-1312, 2001.

Chen et al., "Efficient class II major histocompatibility complex presentation of endogenously synthesized hepatitis C virus core protein by Epstein-Bar virus-transformed B-lymphoblastoid cell lines to CD4+ T cells," *Journal of Virology*, 72(10):8301-8308, 1998.

Cox et al., "Identification of a peptide recognized by five melanoma-specific human cytotoxic t cell lines," *Science*, 264:716-719, 1994.

Di Bisceglie et al., "New therapeutic strategies for hepatitis C," *Hepatology*, 35:224-231, 2002.

Drew and Lalezari, "Cytomegalovirus: disease syndromes and treatment," *Curr Clin Top Infect Dis*, 19:16-29, 1999.

Elliot et al. "Recognition of out-of-frame major histocompatibility complex class I-restricted epitopes in vivo," *European Journal of Immunology*, 26:1175-1179, 1996.

Fleckenstein et al., "New ligands binding to the human leukocyte antigen class II molecule DRB+0101 based on the activity pattern of an undecappeptide library," *European Journal of Biochemistry*, 240:71-77, 1996.

Greten et al., "Development and use of multimeric major histocompatibility complex molecules," *Clinical and Diagnostic Laboratory Immunology*, 9(2):216-220, 2002.

Hammer et al., "Promiscuous and allel-specific anchors in HLA-DR-binding peptides," *Cell*, 74:197-203, 1993.

Heemels et al., "Generation, translocation and presentation of mhc class I-restricted peptides," *Annu Rev Biochem*, 64:463-491, 1995.

Hunziker et al., "In vitro studies of core peptide-bearing immunopotentiating reconstituted influenza virosomes as a non-live prototype vaccine against hepatitis C virus," *International Immunology*, 14(6):615-626, 2002.

Kern et al., "Analysis of cd8 t cell reactivity to cytomegalovirus using protein-spanning pools of overlapping pentadecapeptides," *Eur J Immun*, 30:1676-1682, 2000.

Kern et al., "Target structures of the cd8+-t-cell response to human cytomegalovirus: the 72-kilodalton major immediate-early protein revisited," *J Virol*, 73:8179-8184, 1999.

Klein, *Natural History of the MHC*, John Wiley and Sons, 1986.

Komanduri et al., "Restoration of cytomegalovirus-specific cd4+ t-lymphocyte responses after ganciclovir and highly active antiretroviral therapy in individuals infected with HIV-1," *Nat Med*, 4:953-956, 1998.

Kwok et al., "Rapid epitope identification from complex class-II-restricted T-cell antigens," *Trends in Immunology*, 22(11):583-588, 2001.

Lauer et al., "Comprehensive analysis of CD8+-T-cell responces against hepatitis C virus reveals multiple unpredicted specificities," *Journal of Virology*, 76(12):6104-6113, 2002.

Maecker, "Use of overlapping peptide mixtures as antigens for cytokine flow cytometry," *J Immunol Methods*, 255:27-40, 2001.

Malarkannan et al., "Presentation of out-of-frame peptide/MHC class I complexes by a novel translation initiation mechanism," *Immunity*, 10:681-690, 1999.

Maynard et al. "An alternative translation reading frame encodes an immunodominant retroviral CTL determinant expressed by an immunodeficiency-causing retrovirus," *J. of Immunology*, 160:39-50, 1998.

Maynard et al. "Non-traditionally derived CTL epitopes: exceptions that prove the rules?" *Immunology Today*, 19:551-556, 1998.

Morgan et al., "The influence of exogenous peptide on beta2-microglobulin exchange in the HLA complex: analysis in real time," *Immunogenetics*, 48:98-107, 1998.

Novak et al., "Tetramer-guided epitope mapping: rapid identification and characterization of immunodominant CD4+ T cell eiptopes from complex antigens," *The Journal of Immunology*, 166:6665-6670, 2001.

Parker et al., "Scheme for ranking potential HLA-A2 binding peptides based on independent binding of individual peptide sidechains," *J. Immunol.*, 152:163, 1994.

Plotkin et al., "Vaccination against cytomegalovirus, the changeling demon," *Pediatr Infect Dis J*, 18:313-325, 1999.

Reddehase, "The immunogenicity of human and murine cytomegaloviruses," *Curr Opin Immunol*, 12:390-396, 2000.

Shastri et al., "Major histocompatibility class I molecules can present cryptic translation products to T-cells.," *J. Biol. Chem.* 270:1088-1091, 1995.

Smith et al., "Peptide sequences binding to MHC class II proteins," *Molecular Immunology*, 31:1431-1437, 1994.

Stern and Wiley, "Antigenic peptide binding by class I and class II histocompatibility proteins," *Structure*, 2:245-251, 1994.

Stevens et al., "Efficient generation of major histocompatibility complex class I-peptide complexes using synthetic peptide libraries," *Journal of Biological Chemistry*, 273:2874-2884, 1998.

Tana et al., "An HLA-binding-motif-aided peptide epitope library: a novel library design for the screening of HLA-DR4-restricted antigenic peptides recognized by CD4+ T cells," *J Hum Genet*, 43:14-21, 1998.

Tobery, "A simple and efficient method for the monitoring of antigen-specific T cell responses using peptide pool arrays in a modified elispot assay," *J Immunol Methods*, 254:59-66, 2001.

Tourdot et al., "A general strategy to enhance immunogenicity of low-affinity HLA-A2.1-associated peptides: implication in the identification of cryptic tumor epitopes," *Eur. J. Immunol.* 30:3411-3421, 2000.

Van den Eynde and van der Bruggen, "T cell defined tumor antigens," *Curr Opin Immunol*, 5:684-693, 1997.

Varaklioti et al., "Alternative translation occurs within the core coding region of the hepatitis C viral menome," *The Journal of Biological Chemistry*, 227:17713-17721, 2002.

Villadangos, "Proteolysis in mhc class II antigen presentation: who's in charge," *Immunity*, 12:233-239, 2000.

Waldrop et al., "Normal human cd4+ memory t cells display broad heterogeneity in their activation threshold for cytokine synthesis," *J Immunol*, 161:5284, 1998.

Walewski et al., "Evidence for a new hepatitis C virus antigen encoded in an overlapping reading frame," *RNA*, 7:710-721, 2001.

Wang et al., "Sequence variation in the gene encoding the nonstructural 3 protein of hepatitis C virus: evidence for immune selection," *J. Mol. Evol.*, 54:456-473, 2002.

Weekes et al., "Human CD28-CD28+ T cells contain greatly expanded functional virus-specific memory CTL clones," *J. Immunol*, 162:7569-7577, 1999.

Weekes et al., "The memory cytotoxic T-lymphocyte (CTL) response to human cytomegalovirus infection contains individual peptide-specific CTL clones that have undergone extensive expansion in vivo," *J. Virol.*, 73(3):2099-2108, 1999.

Wolfel et al., "Isolation of naturally processed peptides recognized by cytolytic t lymphocytes(ctl) on human emlanoma cells in association with hla-a2.1," *Int. J. Cancer*, 57:413-419, 1994.

Wong et al., "Detection of diverse hepatitis C virus (HCV)-specific cytotoxic T lymphocytes in peripheral blood of infected persons by screening for responses to all tranlated proteins of HCV," *Journal of Virology*, 75(3):1229-1235, 2001.

Xu et al., "Synthesis of a novel hepatitis C virus protein by ribosomal frameshift," *The EMBO Journal*, 20:3840-3848, 2001.

Zaia et al., "Cytomegalovirus prevention and treatment in 2000," *Hematology*, 339-355, 2000.

"Aluminiumhydroxide," Röempp, 10th Ed., pp. 139-140, 2006 (in German).

Battegay et al., "Patients with chronic hepatitis C have circulating cytotoxic T cells which recognize hepatitis C virus-encoded peptides binding to HLA-A2.1 molecules," *J. Virol.*, 69(4):2462-2470, 1995.

Bellentani et al., "Epidemiology of hepatitis C virus infection in Italy: the slowly unraveling mystery," *Microbes Infect.*, 2(14):1757-63, 2000.

Blake et al., "Use of combinatorial peptide libraries to construct functional mimics of tumor epitopes recognized by MHC class I-restricted cytolytic T lymphocytes," *J. Exp. Med.*, 184:121-130, 1996.

Chang et al., "Identification of HLA-A3 and -B7-restricted CTL response to hepatitis C virus in patients with acute and chronic hepatitis C," *J. Immunol.*, 162:1156-1164, 1999.

Cho et al., "Activation of human neutrophils by a synthetic antimicrobial peptide, KLKLLLLLK-NH2, via cell surface calreticulin," *Eur. J. Biochem.*, 266:878-885, 1999.

Diepolder et al., "Immunodominant CD4+ T-cell epitope within nonstructural protein 3 in acute hepatitis C virus infection," *J. Virol.*, 71(8):6011-6019, 1997.

Duenas-Carrera et al., "Enhancement of the immune response generated against hepatitis C virus envelope proteins after DNA vaccination with polyprotein-encoding plasmids," *Biotechnol. Appl. Biochem.*, 35:205-212, 2002.

Farci and Purcell, "Clinical significance of hepatitis C virus genotypes and quasispecies," *Semin Liver Dis.*, 20(1):103-26, 2000.

Gruener et al., "Sustained dysfunction of antiviral CD8+ T lymphocytes after infection with hepatitis C virus," *J. Virol.*, 75:5550-5558, 2001.

Heile et al., "Evaluation of hepatitis C virus glycoprotein E2 for vaccine design: an endoplasmic reticulum-retained recombinant protein is superior to secreted recombinant protein and DNA-based vaccine candidates," *J. Virol.*, 74(15):6885-6892, 2000.

Hemmer et al., "Predictable TCR antigen recognition based on peptide scans leads to the identification of agonist ligands with no sequence homology," *J. Immunol.*, 160:3631-3636, 1998.

Hemmer et al., "The use of soluble synthetic peptide combinatorial libraries to determine antigen recognition of T cells," *J. Peptide Res.*, 52:338-345, 1998.

HLA-prevalence studies, In: HLA 1998, (Gjertson and Terasaki, eds.) American Society for Histocompatibility and Immunogenetics, Lenexa, Kansas, pp. 103-263, 1998.

Hoffmann et al., "Mapping of Immunodominant CD4+ T Lymphocyte Epitopes of Hepatitis C Virus Antigens and Their Relevance During the Course if Chronic Infection," *Hepatology*, 21(3):632-638, 1995.

Ibe et al., "Identification and characterization of a cytotoxic T cell epitope of hepatitis C virus presented by HLA-B*3501 in acute hepatitis," *J. Gen. Virol.*, 79:1735-1744, 1998.

Inchauspe and Feinstone, "Development of a hepatitis C virus vaccine," *Clinics in Liver Disease*, 7:243-259, 2003.

Keilholz et al., "Immunologic monitoring of cancer vaccine therapy: results of a workshop sponsored by the Society for Biological Therapy," *J Immunother.*, 25(2):97-138, 2002.

Koziel et al., "Hepatitis C virus (HCV)-specific cytotoxic T lymphocytes recognize epitopes in the core and envelope proteins of HCV," *J. Virol.*, 67:7522-7532, 1993.

Koziel et al., "HLA class I-restricted cytotoxic T lymphocytes specific for hepatitis C virus. Identification of multiple epitopes and characterization of patterns of cytokine release," *J. Clin. Invest.*, 96:2311-2321, 1995.

Kurokohchi et al., "A novel cytotoxic T-cell epitope presented by HLA-A24 molecule in hepatitis C virus infection," *J. Hepatology*, 34:930-935, 2001.

Lamonaca et al., "Conserved Hepatitis C Virus Sequences Are Highly Immunogenic for CD4+ T Cells: Implications for Vaccine Development," *Hepatology*, 30(4):1088-1098, 1999.

Lechmann and Liang, "Vaccine development for hepatitis C," *Seminars in Liver Disease*, 20:211-226, 2000.

Leroux-Roels et al., "Lymphoproliferative Responses to Hepatitis C Virus Coes, E1, E2, and NS3 in Patients With Chronic Hepatitis C Infection Treated With Interferon Alfa," *Hepatology*, 23(1):8-16, 1996.

Liang et al., "Pathogeneis, Natural History, Treatment, and Prevention of Hepatitis C," *Ann Intern Med.*, 132(4):296-305, 2000.

McCluskie et al., "Parenteral and mucosal prime-boost immunization strategies in mice with hepatitis B surface antigen and CpG DNA," *Fems Immunol and Medical Microbiol*, 32:179-185, 2002.

Nakajima et al., "Chemotherapeutic activity of synthetic antimicrobial peptides: correlation between chemotherapeutic activity and neutrophil-activating activity," *FEBS Lett.*, 415:64-66, 1997.

Rammensee et al., "SYFPEITHI: database for MHC ligands and peptide motifs," *Immunogenetics*, 50:213-219, 1999.

Rehermann et al., "Differential cytotoxic T-lymphocyte responsiveness to the hepatitis B and C viruses in chronically infected patients," *J. Virol.*, 70(10):7092-7102, 1996.

Rollier et al., "Control of heterologous hepatitis C virus infection in chimpanzees is associated with the quality of vaccine-induced peripheral T-helper immune response," *J. Virol.*, 78(1):187-196, 2004.

Sarobe et al., "Enhanced in vitro potency and in vivo immunogenicity of a CTL epitope from hepatitis C virus core protein following amino acid replacement at secondary HLA-A2.1 binding positions," *J. Clin. Invest.*, 102(6):1239-1248, 1998.

Shirai et al., "An epitope in hepatitis C virus core region recognized by cytotoxic T cells in mice and humans," *J. Virol.*, 68(5):3334-3342, 1994.

Sturniolo et al., "Generation of tissue-specific and promiscuous HLA ligand databases using DNA microarrays and virtual HLA class II matrices," *Nature Biotechnology*, 17:555-562, 1999.

Thursz et al., "Influence of MHC class II genotype on outcome of infection with hepatitis C virus. The HENCORE group. Hepatitis C European Network for Cooperative Research," *Lancet*, 354(9196):2119-24, 1999.

Vernacchio et al., "Effect of monophosphoryl lipid A (MPL) on T-helper cells when administered as an adjuvant with pneumococcal-CRM197 conjugate vaccine in healthy toddlers," *Vaccine*, 20(31-32):3658-67, 2002.

Ward et al., "Cellular immune responses against hepatitis C virus: the evidence base 2002," *Clin Exp Immunol.*, 128(2):195-203, 2002.

Weiner et al, "Persistent hepatitis C virus infection in a chimpanzee is associated with emergence of a cytotoxic T lymphocyte escape variant," *Proc Natl Acad Sci U S A.*, 92(7):2755-9, 1995.

Wentworth et al., "Identification of A2-restricted hepatitis C virus-specific cytotoxic T lymphocyte epitopes from conserved regions of the viral genome," *Int. Immunol.*, 8(5):651-659, 1996.

Wilson et al., "Immunogenicity. I. Use of peptide libraries to identify epitopes that activate clonotypic CD4+ T cells and induce T cell responses to native peptide ligands," *J. Immunol.*, 163:6424-6434, 1999.

Wong et al., "Liver-derived CTL in hepatitis C virus infection: breadth and specificity of responses in a cohort of persons with chronic infection," *J. Immunol.*, 160:1479-1488, 1998.

Aichinger et al., "Major histocompatibility complex class II-dependent unfolding, transport, and degradation of endogenous proteins," *J. Biol. Chem.*, 272:29127-29136, 1997.

Bihl et al., "Impact of HLA-B alleles, epitope binding affinity, functional avidity, and viral coinfection on the immunodominance of virus-specific CTL responses," *J. Immunol.*, 176:4094-4101, 2006.

Brooks et al., "HLA-B27 subtype polymorphism and CTL epitope choice: studies with EBV peptides link immunogenicity with stability of the B27:peptide complex," *J. Immunol.*, 161:5252-5259, 1998.

Field, "Human cytomegalovirus: challenges, opportunities and new drug development," *Antiviral Chem. Chemotherapy*, 10:219-232, 1999.

Fowler et al., "The outcome of congenital cytomegalovirus infection in relation to maternal antibody status," *New Engl. J. Med.*, 326:663-673, 1992.

Gallot et al., "Purification of Ag-specific T lymphocytes after direct peripheral blood mononuclear cell stimulation followed by CD25 selection. I. Application to CD4(+) or CD8(+) cytomegalovirus phosphoprotein pp65 epitope determination," *J. Immunol.*, 167:4196-4206, 2001.

Gavin et al., "Alkali hydrolysis of recombinant proteins allows for the rapid identification of class I MHC-restricted CTL epitopes," *J. Immunol.*, 151:3971-3980, 1993.

Gorga et al., "Purification and characterization of class II histocompatibility antigens from a homozygous human B cell line," *J. Biol. Chem.*, 262:16087-16094, 1987.

Greenberg and Riddell, "Deficient Cellular Immunity-Finding and Fixing the Defects," *Science*, 285:546-551, 1999.

Khattab et al., "Three T-cell epitopes within the C-terminal 265 amino acids of the matrix protein pp65 of human cytomegalovirus recognized by human lymphocytes," *J. Med. Virol.*, 52:68-76, 1997.

Kronenberg et al., "Conserved lipid and peptide presentation functions of nonclassical class I molecules," *Immunol. Today*, 20:515-521, 1999.

Kuzushima et al., "Efficient Identification of HLA-A*2402-restricted cytomegalovirus-specific CD8+ T-cell epitopes by a computer algorithm and an enzyme-linked immunospot assay," *Blood*, 98:1872-1880, 2001.

Lalvani et al., "Rapid effector function in CD8+ memory T cells," *J. Exp. Med.*, 186:859-865, 1997.

Lamas et al., "Relationship between peptide binding and T cell epitope selection: a study with subtypes of HLA-B27," *Int. Immunol.*, 10:259-266, 1998.

Levitsky et al., "Supermotif Peptide Binding and Degeneracy of MHC: Peptide Recognition in an EBV Peptide-Specific CTL Response with Highly Restricted TCR Usage," *Human Immunol.*, 61:972-984, 2000.

Masuoka et al., "Identification of the HLA-A24 peptide epitope within cytomegalovirus protein pp65 recognized by CMV-specific cytotoxic T lymphocytes," *Viral Immunology*, 14:369-377, 2001.

McLaughlin-Taylor et al., "Identification of the major late human cytomegalovirus matrix protein pp65 as a target antigen for CD8+ virus-specific cytotoxic T lymphocytes," *J. Med. Virol.*, 43:103-110, 1994.

Nichols and Boeckh, "Recent advances in the therapy and prevention of CMV infections," *J. Clin. Virol.*, 16:25-40, 2000.

Nijman et al., "Identification of peptide sequences that potentially trigger HLA-A2.1-restricted cytotoxic T lymphocytes," *Eur. J. Immunol.*, 6:1215-1219, 1993.

Retriere et al., "Generation of cytomegalovirus-specific human T-lymphocyte clones by using autologous B-lymphoblastoid cells with stable expression of pp65 of IE1 proteins: a tool to study the fine specificity of the antiviral response," *J. Virol.*, 74:3948-3952, 2000.

Saulquin et al., "A global appraisal of immunodominant CD8 T cell responses to Epstein-Barr virus and cytomegalovirus by bulk screening," *Eur. J. Immunol.*, 30:2531-2539, 2000.

Sia and Patel, "New strategies for prevention and therapy of cytomegalovirus infection and disease in solid-organ transplant recipients," *Clin. Microbiol. Rev.*, 13:83-121, 2000.

Solache et al., "Identification of three HLA-A*0201-restricted cytotoxic T cell epitopes in the cytomegalovirus protein pp65 that are conserved between eight strains of the virus," *J. Immunol.*, 163:5512-5518, 1999.

Tynan et al., "The immunogenicity of a viral cytotoxic T cell epitope is controlled by its MHC-bound conformation," *J. Exp. Med.*, 202:1249-1260, 2005.

Udaka et al., "Decrypting the structure of major histocompatibility complex class I-restricted cytotoxic T lymphocyte epitopes with complex peptide libraries," *J. Exp. Med.*, 181:2097-2108, 1995.

Valli et al., "Binding of myelin basic protein peptides to human histocompatibility leukocyte antigen class II molecules and their recognition by T cells from multiple sclerosis patients," *J. Clin. Invest.*, 91:616-628, 1993.

Von Son et al., "Overcoming the problem of cytomegalovirus infection after organ transplantation: calling for Heracles?," *Intervirology*, 42:285-290, 1999.

\* cited by examiner

Fig. 5a: Vaccination of mice with ncORF derived peptides from influenza A virus in combination with KLK/o-d(IC)$_{13}$ IFN-γ ELIspot

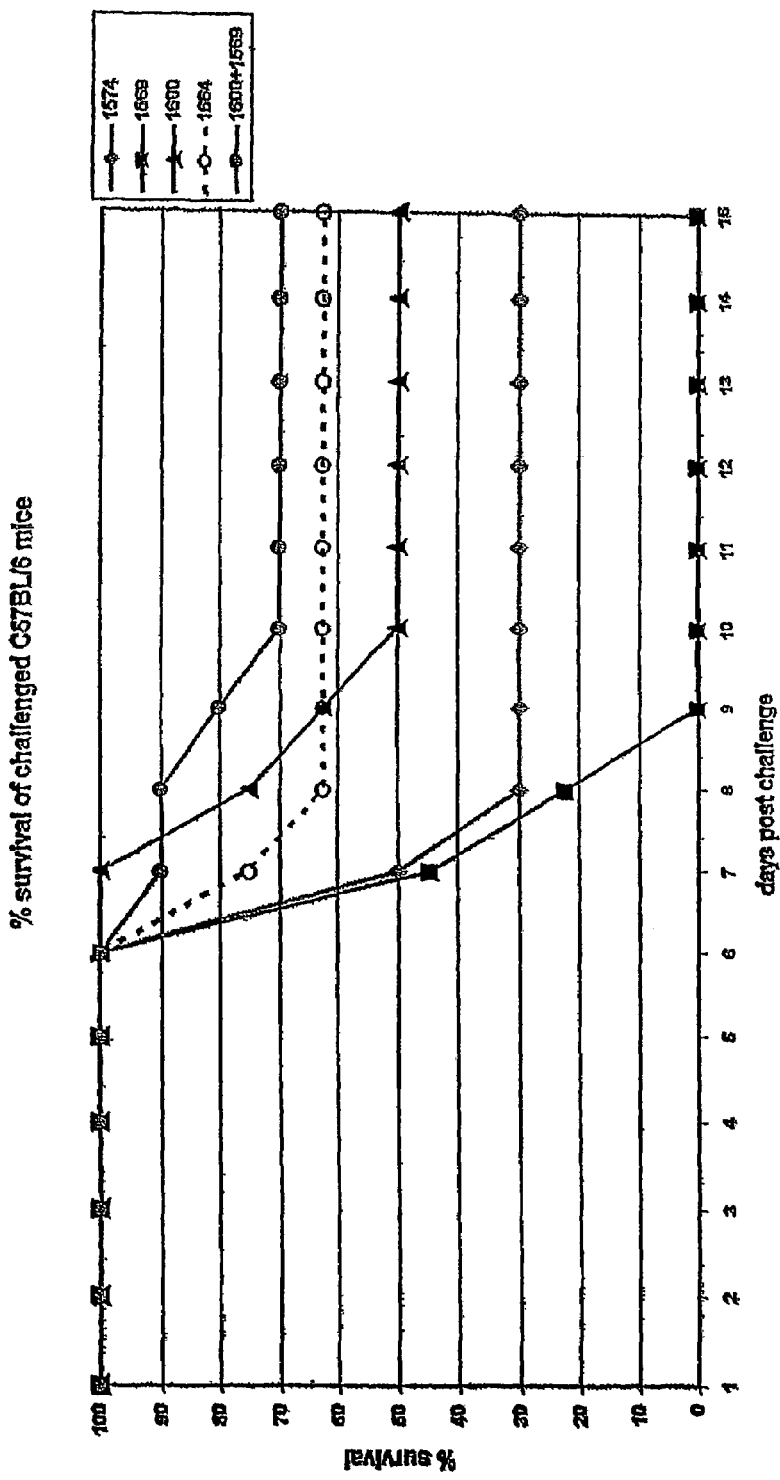
Fig. 5b: Vaccination of mice with ncORF derived peptides from influenza A virus in combination with KLK/o-d(I

ANTIGENS ENCODED BY ALTERNATIVE READING FRAMES FROM PATHOGENIC VIRUSES

This application is a national phase application under 35 U.S.C. § 317 of International Application No. PCT/EP2003/008112 filed 24 Jul. 2003, which claims priority to Austrian Application No. A 1124/2002 filed 24 Jul. 2002 and European Patent Application No. 03450171.8 filed 11 Jul. 2003.

The Sequence Listing is submitted on one compact disc (Copy 1), together with a duplicate thereof (Copy 2), each created on Jul. 21, 2005, and each containing one 2,190 kb file entitled "SONN060SEQ.txt." The material contained on the compact disc is specifically incorporated herein by reference.

The invention relates to peptides derived from pathogenic viruses.

For several viral infections it has become more and more clear that an early effective and strong CTL response to most encoded viral proteins is critical to overcome or clear a viral infection from the host.

Selection for mutations within CTL epitopes of HIV demonstrates that CTL exert pressure on virus replication in vivo, and studies in macaques have provided compelling in vivo data for the role of CD8+ T cells in controlling viremia in both acute and chronic simian immunodeficiency virus (SIV) infection. HIV-infected individuals who are treated during acute infection show enhancement of both CTL and T helper cell responses against HIV associated with subsequent viral control after treatment interruption.

Therefore the identification of precise epitopes from most (if not all) viral proteins is a major goal in view of understanding the hosts immune response and most important for the design of new and effective vaccines against those pathogens.

As up to now, most research for the identification of those epitopes has focused mainly on those proteins of the viruses which are encoded in the actually transcribed open reading frames (ORF's), i.e. the structural proteins and the proteins which have a certain function for the virus, e.g. for its regulation, replication or reproduction.

Although some research has been performed in investigating in potential alternative reading frames of pathogens, the topic of such alternative reading frames has up to now only been regarded as relevant for tumor antigens, but not for viral pathogens, despite some reports about overlapping reading frames in HCV (see Walewski et al. (RNA 7 (2001) 710-721) and WO99/63941) and other viruses or antigens (Bullock et al. (J. Exp. Med. 186(7) (1997), 1051-1058), Malarkannan et al. (Immunity 10(1999) 681-690) and Shastri et al. (J. Biol. Chem. 270(3) (1995) 1088-1091). All these reported viral polypeptides have starting codons other than AUG or ATG leading to peptides starting with e.g. Ala, Leu, Pro or Gly. Moreover these viral peptides according to the prior art were no T cell epitopes, but—at best—were able to elicit an antibody response.

It is an object of the present invention to provide further means for combating viral infections. It is a further object to provide means for replacing or improving existing or proposed vaccines against viral pathogens, especially human pathogens. A specific aim is to provide effective T cell epitopes against viral pathogens.

Therefore, the present invention provides a polypeptide encoded by an alternative reading frame of a pathogenic virus, characterized in that said polypeptide starts with a methionine amino acid residue, comprises an antigenic determinant and comprises more than 7 amino acid residues and fragments of said polypeptide comprising more than 7 amino acids.

Surprisingly, such epitopes (antigenic determinants) proved to be highly relevant in infections with pathogenic viruses. Indeed, T cell responses against such alternatively encoded epitopes are detectable in patients suffering such infections. It seems that upon infection of a virus into a host cell, not only those ORFs of the viral genome, which give rise to the viral proteins, are transcribed, but also some of those proteins or fragments which are encoded by other frames of the genome.

Such a polypeptide according to the present invention may be defined as an antigenic sequence within an ORF of the genome but outside the primarily (main) transcribed ORF of a given pathogenic virus.

Alternative reading frame as used in the context of the present invention is defined as a reading frame which is different from the open reading frames (=main frames) which encode utilized codons of an organism or virus for the expression of e.g. structural proteins or non structural proteins.

Typically but not exclusively a main frame starts with the first coding start codon, e.g. AUG or GUG of a nucleic acid eg. of a messenger RNA or an RNA from a positive/negative stranded RNA virus. Alternative frames described in this invention do not use these start codons or any other codon used by the main frames, respectively.

The present invention considers 5 such alternative reading frames which by a second name are also called non-coding open reading frames (ncORFs), to be distinctive from the main frames as described above. One such alternative reading frame is the +1 frame, which uses codons that start with the next nucleotide 3' prime of the 5' prime nucleotide of a main frame codon. A second such frame is the +2 frame which uses codons of which the 5' prime nucleotide is identical with a 3' prime nucleotide of a codon of the main coding frame. Alternative reading frames 4, 5 and six are encoded by a nucleic acid which is complementary to a nucleic acid, encoding alternative reading frames 1 and 2 respectively. The 5' prime nucleotide of a frame 4 codon is complementary to a middle nucleotide of a codon of a +1 frame. The 5' prime nucleotide of a frame 5 codon is complementary to the 5' prime nucleotide of a +1 frame codon and the 5' prime nucleotide of a frame 6 codon is complementary to a 3' prime nucleotide of a +2 frame codon.

Furthermore, alternative reading frames might be located in regions of the genome which are not involved in main frame translations, eg. so called non translated 5' prime or 3' prime regions.

Although these "ncOrfs" ("non coding ORFs") do not display a (yet) known function for the pathogen, they encode for antigenic determinants (B- or T-cell epitopes)

In contrast to all enabling reports about alternatively encoded ORFs in HCV (see Walewski et al., WO99/63941) and other viruses or antigens (Bullock et al., Malarkannan et al., Shastri et al.) the polypeptides according to the present invention have all an AUG or ATG (encoding Methionin) as start codon. Moreover the peptides provided with the present invention contain T cell epitopes as antigenic determinants and are not intended to exclusively elicit an antibody response.

The principle provided with the present invention seems to be a general one in viral infections. It is therefore not restricted to certain viruses or certain groups of viruses. Regarding this, preferred polypeptide or fragments according to the present invention are those from major and prominent (human) pathogenic viruses or pathogenic virus for which currently no proper treatment or active immunisation protocol exists, such as Hepatitis A virus (HAV), Hepatitis B virus (HBV), Hepatitis C virus (HCV), Hepatitis D virus (HDV), Hepatitis E virus (HEV), Hepatitis F virus (HFV) Hepatitis G virus (HGV) Human Immunodeficiency viruses (e.g HIV-1 and HIV-2), Influenza virus, Foot and Mouth Disease virus (FMDV), Ebola virus, HTLV I, HTLV II, SIV, Parvovirus, Papilloma virus, Rotavirus, Adenovirus, Cytomegalovirus, Feline Immunodeficiency virus (FIV), Epstein-Barr virus (EBV), Herpes simplex virus (HSV), Herpes zoster virus (HZV), Measles virus and oncogenic viruses.

With the present invention, a completely new generation of immunogenic epitopes are provided which according to a preferred embodiment are characterized in that the polypeptides and fragments according to the present invention comprise at least one cytotoxic T lymphocyte (CTL-) epitope.

Preferably the polypeptide or fragments according to the present invention comprise a cytotoxic T lymphocyte (CTL-) epitope for a HLA allele selected from the group consisting of A0201, A1, A24, A3, A31, B3501, B4403, B7, B8, especially A0201, or mixtures thereof.

According to a preferred embodiment, the polypeptide or fragments according to the present invention comprise at least one T helper cell epitope.

Preferably, the polypeptide or fragments according to the present invention comprise a T helper cell epitope for a HLA allele selected from the group consisting of DP, DQ, DR or mixtures thereof.

Preferred epitopes according to the present invention are selected from the group listed in table 2a)-n) (Seq.ID No.1-822) or a fragment of said polypeptide comprising more than 7 amino acids and/or epitopes comprising or consisting of a fragment selected from the group listed in table 4a)-n), preferable fragments with a score of 50 or more, more preferred with a score of more than 200, especially fragments with a score of more than 500 (according to the scores given in the table which were determined according to the algorithm reported by Parker et al. (J. Immunol. 152 (1994) 163)).

Further preferred epitopes according to the present invention are the polypeptides selected from the group listed in table 6 and comprising more than 7 amino acid residues (Seq.ID No.823-874) or a fragment of said polypeptide comprising more than 7 amino acid residues.

The polypeptides or fragments according to the present invention may be conjugated to a carrier, especially to an immunomodulating substance. For certain applications, such conjugations result in an improved action of these peptides. It may also be preferred to couple selected hydrophobic (F, I, L, A, Y, W, C) or acidic amino (D or E) acid residues N- and/or C-terminally to the peptides as described in WO 01/78767.

Preferred polypeptides or fragments therefore comprise a tail consisting of two to seven amino acids, said amino acids being selected from F, I, L, A, Y, W or C, at least one of its N- or C-terminus; or a tail consisting of two to seven amino acids, said amino acids being selected from E or D, at least one of its N- or C-terminus.

In specifically preferred conjugates, the polypeptides or fragments according to the present invention are conjugated to an immunomodulating substance selected from the group comprising polycationic substances, especially polycationic polypeptides, and immunomodulating nucleic acids, especially deoxyinosine- and/or deoxyuridine containing oligodeoxynucleotides.

Preferably the polycationic substance is a polymer, preferably a polycationic peptide, especially polyarginine, polylysine or an antimicrobial peptide.

The polycationic compound(s) to be used according to the present invention may be any polycationic compound which shows the characteristic effect according to the WO 97/30721. Preferred polycationic compounds are selected from basic polypeptides, organic polycations, basic polyaminoacids or mixtures thereof. These polyaminoacids should have a chain length of at least 4 amino acid residues. Especially preferred are substances containing peptidic bonds, like polylysine, polyarginine and polypeptides containing more than 20%, especially more than 50% of basic amino acids in a range of more than 8, especially more than 20, amino acid residues or mixtures thereof. Other preferred polycations and their pharmaceutical compositions are described in WO 97/30721 (e.g. polyethyleneimine) and WO 99/38528. Preferably these polypeptides contain between 20 and 500 amino acid residues, especially between 30 and 200 residues.

These polycationic compounds may be produced chemically or recombinantly or may be derived from natural sources.

Cationic (poly)peptides may also be polycationic anti-bacterial microbial peptides. These (poly)peptides may be of prokaryotic or animal or plant origin or may be produced chemically or recombinantly. Peptides may also belong to the class of defensines. Such host defense peptides or defensines are also a preferred form of the polycationic polymer according to the present invention. Generally, a compound allowing as an end product activation (or down-regulation) of the adaptive immune system, preferably mediated by APCs (including dendritic cells) is used as polycationic polymer.

Especially preferred for use as polycationic substance in the present invention are cathelicidin derived antimicrobial peptides or derivatives thereof (WO 02/13857, incorporated herein by reference), especially antimicrobial peptides derived from mammal cathelicidin, preferably from human, bovine or mouse, or neuroactive compounds, such as (human) growth hormone (as described e.g. in WO01/24822).

Polycationic compounds derived from natural sources include HIV-REV or HIV-TAT (derived cationic peptides, antennapedia peptides, chitosan or other derivatives of chitin) or other peptides derived from these peptides or proteins by biochemical or recombinant production. Other preferred polycationic compounds are cathelin or related or derived substances from cathelin, especially mouse, bovine or especially human cathelins and/or cathelicidins. Related or derived cathelin substances contain the whole or parts of the cathelin sequence with at least 15-20 amino acid residues. Derivations may include the substitution or modification of the natural amino acids by amino acids which are not among the 20 standard amino acids. Moreover, further cationic residues may be introduced into such cathelin molecules. These cathelin molecules are preferred to be combined with the antigen/vaccine composition according to the present invention. However, these cathelin molecules surprisingly have turned out to be also effective as an adjuvant for a antigen without the addition of further adjuvants. It is therefore possible to use such cathelin molecules as efficient adjuvants in vaccine formulations with or without further immunactivating substances.

Another preferred polycationic substance to be used according to the present invention is a synthetic peptide containing at least 2 KLK-motifs separated by a linker of 3 to 7 hydrophobic amino acids, especially L (WO 02/32451, incorporated herein by reference).

The immunomodulating nucleic acids to be used according to the present invention can be of synthetic, prokaryotic and eukaryotic origin. In the case of eukaryotic origin, DNA should be derived from, based on the phylogenetic tree, less developed species (e.g. insects, but also others). In a preferred embodiment of the invention the immunogenic oligodeoxynucleotide (ODN) is a synthetically produced DNA-molecule or mixtures of such molecules. Derivates or modifications of ODNs such as thiophosphate substituted analogues (thiophosphate residues substitute for phosphate) as for example described in US patents U.S. Pat. Nos. 5,723,335 and 5,663,153, and other derivatives and modifications, which preferably stabilize the immunostimulatory composition(s) but do not change their immunological properties, are also included. A preferred sequence motif is a six base DNA motif containing an (unmethylated) CpG dinucleotide flanked by two 5' purines and two 3' pyrimidines (5'-Pur-Pur-C-G-Pyr-Pyr-3'). The CpG motifs contained in the ODNs according to the present invention are more common in microbial than higher vertebrate DNA and display differences in the pattern of methylation. Surprisingly, sequences stimulating mouse APCs are not very efficient for human cells. Preferred palindromic or non-palindromic ODNs to be used according to the present invention are disclosed e.g. in Austrian Patent applications A 1973/2000, A 805/2001, EP 0 468 520 A2, WO 96/02555, WO 98/16247, WO 98/18810, WO 98/37919, WO 98/40100, WO 98/52581, WO 98/52962, WO 99/51259 and WO 99/56755 all incorporated herein by reference. Apart from stimulating the immune system certain ODNs are neutralizing some immune responses. These sequences are also included in the current invention, for example for applications for the treatment of autoimmune diseases. ODNs/DNAs may be produced chemically or recombinantly or may be derived from natural sources. Preferred natural sources are insects.

Alternatively, also nucleic acids based on hypoxanthine and cytosine (as e.g. described in the WO 01/93905) or deoxynucleic acids containing deoxyinosine and/or deoxyuridine residues (described in the PCT/EP02/05448, incorporated herein by reference) may preferably be used as immunostimulatory nucleic acids for the present invention.

Of course, also mixtures of different immunogenic nucleic acids may be used according to the present invention.

The above mentioned substances may be used as conjugates with the present peptides or fragments or as mixtures. The mixtures may either be provided in a form already mixed or as a kit of single components intended to be mixed before application.

The preferred polypeptides or fragments according to the present invention comprise a T cell epitope.

Surprisingly, with the present invention not only polypeptides or fragments having a shifted reading frame (i.e. reading frame 2 and 3) are provided as clinically relevant peptides, but also such peptides and fragments being encoded by an alternative reading frame which reads on the complementary strand as the functional reading frame of said pathogenic virus, i.e. generally referred to as reading frame 4 to 6 in the present specification. This means that also such reading frames proved to be of importance which are located at the opposite end of the known (functional or structural) gene or e.g. its regulating elements.

Therefore, one further aspect of the present invention consists in all antigens being encoded by alternative reading frames of pathological viruses which read on the complementary strand as the functional reading frame of said pathogenic virus, i.e. generally referred to as reading frame 4 to 6.

Preferred polypeptides or fragments according to the present invention comprise at least one peptide selected from the group of peptides listed in table 4a, 4c, 4e, 4g, 4i, 4k and 4m having a score of 50 or more, more preferred with a score of more than 200, especially with a score of more than 500.

According to a preferred aspect of the present invention the present polypeptides or fragments are used as a therapeutic agent. It is known that especially T cell epitopes may be used as vaccines for prophylactic uses. However, with the peptides and fragments according to the present invention, especially with the HCV derived peptides i.a. in reading frames 2 and 3, also a therapeutic tool for combatting (chronic) infections with such pathogenic viruses, such as HCV, is provided.

The peptides and fragments according to the present invention also include modified epitopes wherein preferably one or two of the amino acids of a given epitope are modified or replaced according to the rules disclosed in e.g. Tourdot et al. (Eur. J. Immunol. 30 (2000), 3411-3421), as well as the nucleic acid sequences encoding such modified epitopes.

According to a preferred aspect, the present invention also relates to a pharmaceutical composition comprising one or more polypeptides or fragments according to the present invention. This pharmaceutical composition may be used for both, prophylactic as well as therapeutic purposes.

As stated above, the present pharmaceutical compositions preferably further comprise an immunomodulating substance, preferably selected from the group comprising polycationic substances, especially polycationic polypeptides, and immunomodulating nucleic acids, especially deoxyinosine- and/or deoxyuridine containing oligodeoxynucleotides.

In the present pharmaceutical compositions, the peptides or fragments according to the present invention may be used alone or in combination with "normal" polypeptides (epitopes, antigenic determinants) of a given pathogenic virus (or combinations of antigens of different pathogens). A preferred embodiment therefore further comprises structural or functional polypeptides of a pathogenic virus or fragments thereof, especially structural or functional polypeptides or fragments thereof comprising an antigenic determinant.

The administration of the pharmaceutical compositions according to the present invention may be performed according to the administration of other known polypeptide vaccines. Preferably, the composition contains per administrable dose 1 ng to 1 g, preferably 100 ng to 10 mg, especially 10 μg to 1 mg, of one or more polypeptides or fragments according to the present invention.

Preferably, the pharmaceutical composition is formulated as a vaccine.

It is preferred that the pharmaceutical composition according to the present invention comprises further active ingredients, especially immunopotentiating cytokines, anti-inflammatory substances, antimicrobial substances or combinations thereof.

It is further preferred that the present pharmaceutical composition further comprises a polycationic polymer selected from the group consisting of a polycationic peptide, especially polyarginine, polylysine or an antimicrobial peptide, especially a cathelicidin-derived antimicrobial peptide, or a growth hormone, especially a human growth hormone.

Additionally, auxiliary substances, especially a pharmaceutically acceptable carrier, buffer substances, stabilizers or combinations thereof are provided with the pharmaceutical composition.

According to another aspect, the present invention also relates to the use of a polypeptide or fragments according to the present invention for the manufacture of a medicament for treating or preventing an infection with said pathogenic virus.

It was not foreseeable within the prior art that upon infection of a virus into a host cell, not only those ORF's of the viral genome, which give rise to the viral proteins, are transcribed, but also some of those proteins or fragments which are encoded by other frames of the genome. This was even more surprising for reading frames 4 to 6.

The invention will hereinafter be described in a more detailed way in the following examples and the figures, yet without being restricted thereto.

FIG. 5 shows that vaccination with ncORF derived peptides from influenza A virus in combination with KLK/o-d (IC)$_{13}$ induces potent IFN-γ producing T cells and protection against viral challenge.

EXAMPLES

Example 1

HCV

Figure 1:
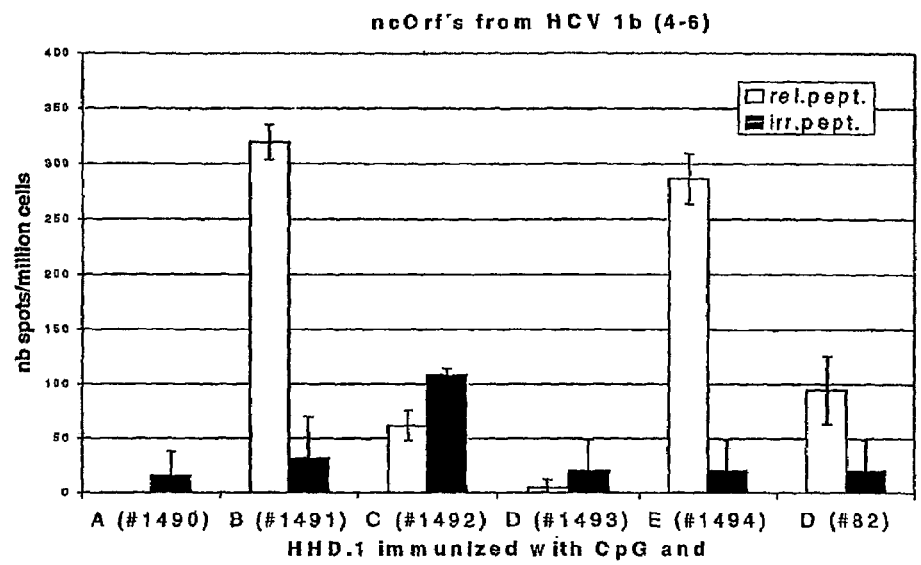
FIG. 1 shows the Elispot assay from the experiment with HLA-A*0201 tg mice+HCV-H77 ncORF 11, 13, 27-derived peptides.

HCV was used as a model virus for the present invention. The principles described in the present example, however, may be applied to any virus.

The entire genomes of 7 clinically relevant strains (1a, 1b, 2a, 2b, 3a, 3b and H77) of HCV were analysed in order to determine all ORF's being longer than 7 amino acid residues and starting with an AUG (Met) codon in all reading frames other than the reading frame for the HCV polyprotein. The HCV genome sequences were taken from the Genbank data base (Accession Nos.: AF387806 (1a), D11355 (1b), AF238485 (2a), AB030907 (2b), AF046866 (3a), D49374 (D26556) (3b), AF011751 (H77)). Altogether, 822 novel ORFs were identified in this study (see summary in table 1).

TABLE 1

Number of ORF's in six different HCV strains

| Strain | Frames | No. of frames* | Seq. ID Nos. | Full sequence listed in table 2 |
|---|---|---|---|---|
| 1a | 1-3 | 42 | 1-42 | Table 2a |
|    | 4-6 | 68 | 43-110 | Table 2b |
| 1b | 1-3 | 56 | 111-166 | Table 2c |
|    | 4-6 | 75 | 167-241 | Table 2d |
| 2a | 1-3 | 47 | 242-288 | Table 2e |
|    | 4-6 | 71 | 289-359 | Table 2f |
| 2b | 1-3 | 45 | 360-404 | Table 2g |
|    | 4-6 | 75 | 405-479 | Table 2h |
| 3a | 1-3 | 38 | 480-517 | Table 2i |
|    | 4-6 | 70 | 518-587 | Table 2j |
| 3b | 1-3 | 53 | 588-640 | Table 2k |
|    | 4-6 | 72 | 641-712 | Table 2l |
| H77 | 1-3 | 40 | 713-752 | Table 2m |
|     | 4-6 | 70 | 753-822 | Table 2n |

(*more than 7 AA long)

The following table 2 contains the full sequences of the polypeptides.

Other HCV subtypes which may also be preferably adapted for the present example include subtypes 1c, 2c, 2d, 3c-f, 4a-j, 5a or 6a.

TABLE 2a (Seq. ID Nos. 1-42)

HCV 1a ncOrf's 1-3
Genbank Accession No.: AF387806

| SEQ ID No. | Sequence | AA |
|---|---|---|
| 1 | MGATLHHESLPCEELLSSRRKRLAMALV | 28 |
| 2 | MAMRAAGGRDGSCLPVALGLAGAPQTPGVGRAIWVRSSIPLRAA SPTSWGTYRSSAPLLEALPGPWRMASGFWKTA | 76 |
| 3 | MQQGTFLVALSLSSFWPCSLA | 21 |
| 4 | MIALTRVLCTRRPMPSCTLRGASLAFARATPRGVGWR | 37 |
| 5 | MANSPRRSFDVTSICLSGAPPSVRPSTWGTCAGLSFLSANCLPS LPGATGRRKVAIALSIPAI | 63 |
| 6 | MIASTPAGWQGFSITTSSTLQAVLRG | 26 |
| 7 | MPTEAAPTSAPTAGTTPQNLAVLCPRRVCVVRYIASLPAPWWWE RPTGRARPPTAGVKMIRTSSSLTIPGHRWAIGSVVPG | 81 |
| 8 | MQHPWPGRTVLYPSSCSSALHGI | 23 |
| 9 | MFITISLLFGTGRTTACEIWPWL | 23 |
| 10 | MEWSPRVGGCWRPSRRTPSRQGAS | 24 |
| 11 | MGCAGLSTTGPERGPSRHPRVLSSRCIPM | 29 |
| 12 | MSFPCAGGVIAGAACCRPGPFPT | 23 |
| 13 | MLPQAAAKAPRSRLHMQLRAIRC | 23 |
| 14 | MGSILTSGPG | 10 |
| 15 | MPHPSWASALSLTKQRLRGRDWLCSPPPPLRAPSLCPIPTSRRL LCPPPERSLFTARLSPSK | 62 |
| 16 | MPWPTTAVLTCPSSRPAAMLSSWQPMPS | 28 |
| 17 | MLSPALNVGAGLAGGSQASTDLWHRGSAPPACSTRPSSVSAMTQ AVLGMSSRPPRLQLGYERT | 63 |
| 18 | MPTFYPRQSRVGRTFLTW | 18 |
| 19 | MGQHPCYTDWALFRMKSP | 18 |
| 20 | MRWKSALSTYRTSSKG | 16 |
| 21 | MARAWRELLWHSRS | 14 |
| 22 | MFPPRTTCRRAMQLPASLPYSAASL | 25 |
| 23 | MPTPRAPVPPFLRRTTRSRYGGCLQRNTWR | 30 |
| 24 | MTPLMLSS | 8 |
| 25 | MAARFHLQSPLLCLRLGRSGRWSSLNQPYLLPWPSSPPEALAAP QLPALRATIRQHPLSPPLLAAPPTPTLSPIPPCPPWRGSLGIRI LATGHGQRSVVRPTRRMSCAAQCLTLGQAHSSPRAPRKNRNCPS MH | 134 |
| 26 | MGQKTSVAMPERP | 13 |
| 27 | MIPAALTPQSLRATSVRRRQSTNVVTSTPKPAWPSSPSPRGFML GALLPIQGGRTAAIAGAARAAY | 66 |
| 28 | MASAHFHSTVTLQVKSIGWPHASENLGYRPCELGDTGPGASALG FWPEEAGLPYVASTSSTGQ | 63 |
| 29 | MPGPAGSGFAYSCLLQG | 17 |
| 30 | MNHSPVRNYCLHAESV | 16 |
| 31 | MPGDLGVPPQDC | 12 |

TABLE 2a-continued
(Seq. ID Nos. 1-42)
HCV 1a ncOrf's 1-3
Genbank Accession No.: AF387806

| SEQ ID No. | Sequence | AA |
|---|---|---|
| 32 | MAPVSPWLSA | 10 |
| 33 | MGYDDELVPYDGVGNGSAAPDPTSHLGHDRWCSLGSPGGHSVFL HGGELGEGPGSAAAICRRRGNPRHRGKCRPHCVWIC | 81 |
| 34 | MHVGRPGGRHEHLGARWRRPGCFGRVLPVNRLRGHSGQGRLVRE AGNHT | 49 |
| 35 | MLRFLAKGHLGLDMRGVERL | 20 |
| 36 | MEGVCRGIRGDKAGGGLPLRDGYDY | 25 |
| 37 | MPVPGPIARIFHRIGRGAPT | 20 |
| 38 | MEAGDGRQHHQG | 12 |
| 39 | MLLQRVSRPRRRWKEGLLPHP | 21 |
| 40 | MPQKTWGTALASLETPGPERPR | 22 |
| 41 | MWQVPLQLGSKNKAQTHSNSGRWPAGLVRLVHGWLQRGRHLSQR VSCPAPLDLVLPTPACCRGRHLPPPQPVKVGVNTPAS | 81 |
| 42 | MSVVQPPGPPLPGEP | 15 |
| | HCV polyprotein | 15 |

TABLE 2b
(Seq. ID Nos. 43-110)
HCV 1a ncOrf's 4-6

| SEQ ID No. | Sequence | AA |
|---|---|---|
| 43 | MIPPPAARACRGAQTYVGAPRPIL | 24 |
| 44 | MEWYTPSLSTGAVASGAGLQ | 20 |
| 45 | MPQELPPRPRHLQGCL | 17 |
| 46 | MKQWRGYQAALTSPPSIVSH | 20 |
| 47 | MRPALRRVRRTSSLNDRR | 18 |
| 48 | MWHPWSGTRHKLLCHKRPPSTRRRQGTCRRWST | 33 |
| 49 | MQPGPWCFCRCLWEHGGEPPGSSGALLVERSYP | 33 |
| 50 | MSGYLAERASPQGLDLHWYTSG | 22 |
| 51 | MVTELAPSTRREQHRHTTRPPPCPARTPAGATPTGAGGEATSRR RCRPLRAPTYPSDTMQSRRTRGRIQDRASRPGMLH | 79 |
| 52 | MWRPDACGSNQWGSAGCCCPPLR | 23 |
| 53 | MPCGDPLYGRDR | 12 |
| 54 | MALPGGGVLEAARHSY | 16 |
| 55 | MRLTDLSQLAVTRAKMEPPLKKEGKERKKEGKKKKKKKKEKKKK KEKKKKKKKKKKKKKKKTGNGLRGRSVYPNLHRLGRR | 82 |
| 56 | MPTPAASRSRQNQIQRGR A | 20 |
| 57 | MAALPPLARSLARTLRARCLQARKGGTPSFLRHAATLLISPGE | 43 |
| 58 | MIGGRSSGSME | 11 |

TABLE 2b-continued
(Seq. ID Nos. 43-110)
HCV 1a ncOrf's 4-6

| SEQ ID No. | Sequence | AA |
|---|---|---|
| 59 | MIMLPSQELTGVCLAVSHAALARGVVGSRVR | 31 |
| 60 | MSSKSYSGCGGSPGGAEYLVIASVKALRLAASSWTPALSQITTK SSPHTSMVQSWSPAARQAARALM | 67 |
| 61 | MATRAWGSRSQHW | 13 |
| 62 | MSLSVTVESKQRVSYENPIGVFLDFHACTRNSTRCPGEYWNP | 42 |
| 63 | MRRAGLRPPFSG | 12 |
| 64 | MMVVSIGVTLSSRRSFHTELMWVTAFLAWQRTSFAP | 36 |
| 65 | MGSFCSSAAHGVTSAPVQE | 20 |
| 66 | MPEVEELPKLLVASSAKAVDRVDSVRTTVRFFRGGGTGGDFGGG SGQPWTTGGS | 54 |
| 67 | MLPPISCLHRRLASMSSASGESWLAVQVALRDGADSWLAEELAT EGGDPLANLRPAASAVIWEGSVSMDVNTATSGSGSQGNCDPTGY SWSPTLNDTSSRSKGLQGGANLCRRTPSNSVKNSGDGTWHGHLR LSVVIPVT | 140 |
| 68 | MGKVPLHNFLQVLGPTILIVPFLTCPVISAPQWQRVCMMPSPRQ TPLYPRWQDTKGIPGSCGMSLAFSQVLKSLNTSHIQSQMSLSQE PEHGVVHSELIHWCSRLRSWVTVRLLSMAVTRAAASLSGT | 128 |
| 69 | MAGSRLTRSSVEGTSPLMILNATRAPATPAPYPARMSMRTFPSP TLPMAAPAKPAPTKAVAAPGAASWAATHPPNMLKRRVWLVVSGL VTAAVKAINEAMAGLPGSVDKPAKYCIPLMKFHICFAQKVSSFC QLVWTAGAITSA | 144 |
| 70 | MIAGFPDKTTLPTMTTQPVDRQYAAKAARTPPTSTQVLVTTSRS ADMHVMMYLVTGCVRVISF | 63 |
| 71 | MYARSLTVVSAGVSSYQAQPAS | 22 |
| 72 | MPEGRSPGATNL | 12 |
| 73 | MPGFPLPVLPRR | 12 |
| 74 | MVKVGSRLKSTVWVTHVLQSITESKSPV | 28 |
| 75 | MRASVATTTTSPLVGMTDTSRPR | 23 |
| 76 | MPNATSFAASSSHFFFE | 17 |
| 77 | MRCLPPLITSRGIALP | 16 |
| 78 | MLGWGTVTEPGGVAVASTTSLAPAVSAWSRTVPMPKMDVASVEW HSSQIIMS | 52 |
| 79 | MGLPVVIVLTPVLMLGSIP | 19 |
| 80 | MVVSRFSTGIKSTALATPRVHTAALNMPTACPAGHNSGPPEEPF K | 45 |
| 81 | MGRGDSRLPLLSPRRRTGMTSACLVTR | 27 |
| 82 | MTGPLGDAMVLVPAPW | 16 |
| 83 | MHVARKVWAAVDTIWTSPSTWFLSRPVRLVIHMPRRPLVCWAYA VMGASNLQPLETIPSAGPSSISRPLRAETGKPLMMSPHAAVSAP HVMSLVSIWEKTTGSTATARSRKPLCAQSRRGVRWL | 124 |

TABLE 2b-continued

(Seq. ID Nos. 43-110)

HCV 1a ncOrf's 4-6

| SEQ ID No. | Sequence | AA |
|---|---|---|
| 84 | MSNTRVGCTAHMSKMTASRPPRTLRGGIHTCSCASTLVRKY | 41 |
| 85 | MSSIIHKQEQTRASASRRNRRTTYSHLMAQDAMLDPTPYKYCTS TMFWWRWMRPVDKAGRVVKEHGRTCHCVVVSSNGLSSDLSLSSR SQRSPRVQLQAASSLCSTPPTYILILNIV | 117 |
| 86 | MTQGGAPHTLVNPVEFIQVQPNQLPSGGLVLLRTKTSVSFSPQL | 44 |
| 87 | MEKYAMPARTPQ | 12 |
| 88 | MSKMACGIRSS | 11 |
| 89 | MASAASYTILELGQSLVTW | 19 |
| 90 | MYPMRSAKPHVRVSMTLPKLRDLRRGSVGPQLGREPRGDRSHPA HPQPSLP | 51 |
| 91 | MVHGLRDLPGHSQAPYQAVPQGLSRPNTTRLAVLRGHAQISRH | 43 |
| 92 | MICREASISTLCSHAAHGPFTASRD | 25 |
| 93 | MRHAVINVSPAVASREPAGQVQLASGRYWSEFELCSYCPVEEVL ATYGSPASSGQKPSADAPGPVSPSSQGRYPKFSEACGHPIDFTW RVTVE | 93 |
| 94 | MESLNDWR | 8 |
| 95 | MGHQYHPRPQCGGKHDYVA | 19 |
| 96 | MATDVFCPITKLGFG | 15 |
| 97 | MAVQNLQSVKCDFLLPLASTA | 21 |
| 98 | MDHRWFVVGLFPRLH | 15 |
| 99 | MVSGASCLERWSG | 13 |
| 100 | MGGISEHGRQHGHVRFGLAR | 20 |
| 101 | MSSDLSSTVAASVHDAVPSPDPLIPALAGHKGDPRQLWHELSF | 43 |
| 102 | MVPPGGEGYQPVHPLHCPLARANVPAQYCCTDHADYEGSGREDG GQ | 46 |
| 103 | MLRPEGLEFLPVGLDSRGDNLCLTGRGLQEAEGLLLELLGEHHP LLDR | 49 |
| 104 | MEGGLEANQTLPHLVPRWGRGLSPSAHGGLVRYQVRKVLPTLLC LG | 46 |
| 105 | MSEACEDALPKFKVVLAHGKPRGVHVRS | 28 |
| 106 | MTEDEMSPPLDYFEGDSLAVKRDLSGGGQSNLLDVGMGHSDGAR RGGGGEHNQSRPRSLCLVKDSADAQDGCGIRGVALVTNYYVISA PRAPAVGKELAVGGVRDGAASGNCSHPGPDVRIDPMSLGHVSTK AQCCSNRGVEY | 143 |
| 107 | MEVSHLEALGHYWWRGVIREHRGPHGCL | 28 |
| 108 | MVINIGASKRP | 11 |
| 109 | MASDHLPR | 8 |
| 110 | MPKPIRVVDQAPGCDPGTGAAPRVCGVRMLAEAISGAVQGVVAR PSDDTRRRSAHFGESS | 60 |

TABLE 2c

(Seq. ID Nos. 111-166)

HCV 1b ncOrf's 1-3
Genbank Accession No.: AF

| SEQ ID No. | Sequence | AA |
|---|---|---|
| 111 | MATRVWGGQDGSCHPVALGLVGAPQTPGVGRVIWVRSSIPLHAA SPTSWGTFRLSAPP | 58 |
| 112 | MASGFWRTA | 9 |
| 113 | MQQGICPVALSLSSS | 15 |
| 114 | MSRTTAPTQVLCMRQRT | 17 |
| 115 | MRRYKIAIAQSIPATYQVTAWLGI | 24 |
| 116 | MTPSKLGSLLRCSTHTGSTRPDVQSAWPAAAPSTSSLRGGVPSL TLCLTSRTRGLIAGTMHPNRAVLYPRRRCVAQCIASPRVLLWWG RPTVPESPRIAGGRMRQTCCYSTTRGRRKATGSAVHG | 125 |
| 117 | MFCCSSFSWRTRASVPACG | 19 |
| 118 | FL | 69 |
| 119 | MFGEAAMPSSSLHARSIQS | 19 |
| 120 | MWTRTSSAGRRPPGRVP | 17 |
| 121 | MLTSFRCAGGATVGGACSPPGLSPT | 25 |
| 122 | MQPKGTRCSSSIRPLPLP | 18 |
| 123 | MASFLPMVVALGALMTS | 17 |
| 124 | MSAIQLTRLQSWASAQSWTKRRRLERGLSCSPPLRLRDRSPCHT QTSRRWPCLILERSPSMAKPSPLKPSGGEGISFSVIPRRSATSS PQSCQASESTLWRITGGSMCPSYQLSETSLSWQQTL | 124 |
| 125 | MTRAVLGTSSPPPRPRLGCGPT | 22 |
| 126 | MHTSCPRPSRQETTSPTW | 18 |
| 127 | MRSPSPTP | 8 |
| 128 | MKWKSAPRTSLTLSRECSSPSSSSRKRSGYCKQPPNKRRLLLPW WSPSGEPLRHSGRSTCGISSAGYST | 69 |
| 129 | MEQEWPARSWPLRS | 14 |
| 130 | MCLRATPQRVLLRSSPALPSLSC | 23 |
| 131 | MRTAPHRVPARG | 12 |
| 132 | MFGTGYARC | 9 |
| 133 | MEHSPSTHTPRAPAHPLQRQTILGRCGGWPLRSTWRSRGWGIST T | 45 |
| 134 | MSLRTLTSSRPTSCGGRRWAGTSPAWSRRTRW | 32 |
| 135 | MRGKYPFRRRSCGNPRSSPQRCPSGRARITTLHC | 34 |
| 136 | MSSAAQCPTHGQAP | 14 |
| 137 | MPQHLAAQACGRRRSPLTDCKSWTTTTGTCSRR | 33 |
| 138 | MGQRTSGTYPARPLTTSTPCGRTCWKTL | 28 |
| 139 | MRFSVSNQRKEAVSQPALSYSQIWESVYARRWPSMMWSPPFLRS | 44 |
| 140 | MTLAVSTQRSPRTTSVLRSQFTNVVTWPPKPDRP | 34 |
| 141 | MCRSPTMHQAKGCTTSPVIPPPPSHGLRGKQLDTLQLTPG | 40 |
| 142 | MRPLCGQG | 8 |

TABLE 2c-continued

(Seq. ID Nos. 111-166)

HCV 1b ncOrf's 1-3
Genbank Accession No.: AF

| SEQ ID No. | Sequence | AA |
|---|---|---|
| 143 | MALAHFHSIVTLQVRSIGWLHASGNLGYHPCESGDIGPGASALG YCPRGGGPPLVASTSSTGQ | 63 |
| 144 | MPGDLGVPPRDC | 12 |
| 145 | MAPVTPWLSA | 10 |
| 146 | MRLRRPHGVHSACRRPPRRRCQGPGAWRPGSGGRRELCNRESAR LLFLYLPLSFAVLFDHPSFRLRGAQRVRDIPCHERLLQLKYCV | 87 |
| 147 | MSRAHGQLPPHRQVRSGVGSHHSRCA | 26 |
| 148 | MRLGSLVDT | 9 |
| 149 | MGVCSAALPSPGGRARLCLLVDDAADSPG | 29 |
| 150 | MAVAPALAGFTTTSLCHGPRDGCIVRRRGFCRSGTLDLVTIL | 42 |
| 151 | MRGPSRANL | 21 |
| 152 | MRGPSRANL | 9 |
| 153 | MHVSAEGRWGSLCPNGLHEAGRADRHVHLQPSYPATGLGPRGPT RPCGGSGARRLLRHGDQDHHLGSRHRGVWGHHLGSARLRPKGKG DTPGPGR | 95 |
| 154 | MHLWQLRPLLGHETC | 15 |
| 155 | MHPGGCEGGGLCARRVHGNYYAVSGLHGQLIPPGRTAVISSGPP TRSHWQRQEY | 54 |
| 156 | MCHPDSRLQLGSHLHH | 16 |
| 157 | MGSNVEVSHTAETYAARANTLAVQAGSRPK | 30 |
| 158 | MWSTDHRTCQKRFHEDRRA | 19 |
| 159 | MRARTGCSSAHFHAHRPLPHHSRNG | 25 |
| 160 | MHYPPCLSGR | 10 |
| 161 | MDRRLDHAMRCGGKQAAHQRVEQLFAAPP | 29 |
| 162 | MLLEGLCSLSSCEAPGLHDARERRRPCRYL | 30 |
| 163 | MFLQCVGRPRCIRQKGVLPHP | 21 |
| 164 | MPQETWGTTLASLETSGQERPR | 22 |
| 165 | MNGELNTPGQ | 10 |
| 166 | MSVVQPPGPPLPGEP | 15 |

HCV polyprotein

TABLE 2d

(Seq. ID Nos. 167-241)

HCV 1b ncOrf's 4-6

| SEQ ID No. | Sequence | AA |
|---|---|---|
| 167 | MICREASISTLCSHAAHGPFTASRD | 25 |
| 168 | MAYWPGVFSSPFIGWGAGRCLPLQKVGVGTA | 31 |
| 169 | MHRGRPTHWRNMMLSAPSRILVGAGPRGGQST | 32 |
| 170 | MKSPWGFSLISRYSPGTRLAAQESTGIRMRSPSRPEEGWRPHHR GPSSRIHGLPDLGIR | 59 |
| 171 | MLWHKPCYGGAAKSCSTR | 18 |
| 172 | MCRTLSSRRHPH | 12 |
| 173 | MIRSCRRS | 8 |
| 174 | MSPSRKAQTTG | 11 |
| 175 | MVAVTQPGIG | 10 |
| 176 | MGTLRCQWSCPSRSGNPPPA | 20 |
| 177 | MFHATCCCRS | 10 |
| 178 | MPSMMLLRGSQAEWISLLSTVSR | 23 |
| 179 | MSQGLATWTPPREQQPPLVWWLFAVTRALSA | 31 |
| 180 | MMEVGPEPWRTPWLGMLPGRGSCLLPAWSGTRSVHLCG | 38 |
| 181 | MCYSRSLSQSRPYSPSSERLLPRQRRLR | 28 |
| 182 | MTAVRPGGMSCP | 12 |
| 183 | MVSRNAPRGAPASRRGPGPH | 20 |
| 184 | MVTRSRVPDLQKPRLRTMQPSLGPWHKLVVVKPARAGATAIRHR EHMPPQGPACL | 55 |
| 185 | MYSRTSCLAAAACC | 14 |
| 186 | MALVRARTRGSGCWRLPFPLSRGCARQRQQRVASQSRP | 38 |
| 187 | MALPGGGVLEAARHSY | 16 |
| 188 | MPTPTESRSRHSMNQRGRARDRL | 23 |
| 189 | MIMLPSQELTGVCLAVSHAARARGVVGSRVR | 31 |
| 190 | MACLASGAKSQHW | 13 |
| 191 | MSFSVTVESKQRVSYEKPMGFFFDFQVFTRNSTRCPGEYWNPYE EPITT | 49 |
| 192 | MMVVSIGVTVSSSKSFHTEWMWLTALLDRFRTSFAP | 36 |
| 193 | MLWWRSKELLNALMGSLLSSAAHGVIKAPVHV | 32 |
| 194 | MEEYDSTSDPLSPSSEAWSGRAVAVPLSTADDSELPKVLVASSA KAEDTEDSVRTTVLFLRGGGIGGALIGGNGHPCTTGGT | 82 |
| 195 | MGIAAGNFLDFRRISAGTDTSLSSSSARSGSKESRTTTLFSDST RVMFPPISCRHRRLASMRSASGETWWVVHVAFKEGADNWLAEEL AKEGGDPLANLRLAVSAVMWEGSVSMEVSTATSGSGSHGSCDPT RYWLSPTWNVTSSRRRGLHAGAYLGNRTPSTSEKNSGAGTWHGH ETLSV VMPVT | 187 |
| 196 | MGNVPCHVLLQVLGPTILMEPPLTCPVICAPHGQVVCMMPSPRQ TPLYPRWHEKKGTPGSCGRSLDWSQVLKSVNTVHIQSQTSLSHE PEHGVEQSSLIHWWSLFSS | 107 |
| 197 | GSRLTRSSVEGISPLMTLKATSAPATPAP | 31 |
| 198 | MSTSTFPRPMLPTAAPAMPAPTKAEAALGGASWAATHPPKMLNR RVLWVVSGLVIEAVNAINDAIAGFPGRVDKPAKYCIPLMKFHMC FAQNVSRAHLDSTTGAAASACLVAVCSNPSAFCLNCSASCIPC SM | |

TABLE 2d-continued

(Seq. ID Nos. 167-241)

HCV 1b ncOrf's 4-6

| SEQ ID No. | Sequence | AA |
|---|---|---|
| 199 | TTLPVVRQYAARAARTPPTSTQVLVTTSRSADMHAMMYLVMGWVRVTSFWTAPSLYSKGVGPCSVGFSRMRHFHI | 76 |
| 200 | MWVRPVKTLSQNSRWSWQTGNPGVFR | 26 |
| 201 | MPEGRSPGVTNL | 12 |
| 202 | MPLLPLPVLPRRCERDTAS | 19 |
| 203 | MVKVGSKLKSTVWVTHVLQSITESKSPV | 28 |
| 204 | MTDTSSPR | 8 |
| 205 | MRCLPPLMASMGMALP | 16 |
| 206 | MFGCGTVTDPGGVAVASTTSRAPAVSAWSRTVPMPKIVVESVEWHSSHIMMS | 52 |
| 207 | MVLTPVLMLGSIPCALDIYAPNPKVAATDGLRTSTLYPWAAYAAGTLVLLPLPVGACRWAT | 61 |
| 208 | MDSTGTKSTAFATPRVHTAARKMPTACPEGQSSGPPEEPFK | 41 |
| 209 | MTSACLVTK | 9 |
| 210 | MMQPSRPRVCWE | 12 |
| 211 | GARSRHPRPSRLSAGPRSISFPLRAETGRPKMMSPHAAVSAPQVMILVSMSEKTTGSTATARSRRPWAQSRSGVRWL | 79 |
| 212 | MYVPVSAPSFMKAIWT | 16 |
| 213 | MPAWSTMSGPSMASRSLVMSKISSGWTAHVRRMMASRPPRTLRGGTHTCKCASALVIKYCNHHMSLARNTL | 71 |
| 214 | MYQAAQKNTRKERRPCAPATDAALRTTRFSKVASAWAISSIIHKQAQTRASARRKSSRTYSHLITTETTTDPTPYRYCTSTIF | 84 |
| 215 | MVKLIVQG | 8 |
| 216 | MLHGGPPHVLVNPVLFIHVQPNQLPCGGRVLLSSSTSVSFSPQLYVGTPERSVVPTTTGLGVKQYTGPHTCDAGTIPHGWGA | 82 |
| 217 | MGRQLAMRSGHPDALNLCA | 19 |
| 218 | MNPVWRESLQFRAVLLMCQLPLVFTSWIF | 29 |
| 219 | MSTTACGIRSSCDTTRAVVGDQFIIISQAMR | 31 |
| 220 | MLLFLAASVGVSATQQREKLLSRTQGTHPGVCMIMSAASYTILELEQSFVTWYIPDTLRTS | 61 |
| 221 | MVKQDSKAKRKIEKEQPGRFPVA | 23 |
| 222 | MYPMRSAKPHVRVSMTLPKLRDLRRGSVGPQLGREPRGDRSHPAHPTPSLP | 51 |
| 223 | MMHGLRDLPGHSQAPYQAVPQGLSRPNTTRLAVSRGHAQISRH | 43 |
| 224 | MRLTDLSQLAVTRAKMEPPLKKEERKREKEGKEKKKKKKKKKNRKWPIGLECLAPRSSVGEQVDAYPYRK | 71 |
| 225 | MSPDSQGWYPKFPEA | 15 |
| 226 | MESFNDLR | 8 |
| 227 | MWGRQLAGFLYG | 12 |
| 228 | MVAQQRVAQRVDGQLAFLRSAWRDQGACPCVGH | 33 |
| 229 | MVGSACRLQGRRRQLAS | 17 |
| 230 | MPRVAAGLRPDDPHGTVFDMSGDLCSTWAGGLHDAVSPPDSLVPALAREKRDSR | 54 |
| 231 | MTENEMPSPPDGFNGDGFAIEGDLSSIRQGHLLDVWVWHGDRSRRRSGGEHDKPRSSRLRLVQDCADQDCSRVS | 75 |
| 232 | MALITYYDVISAPRATTIGKKLAIGRVCDGGACGNGPYPSSDVGVNTVCLRHIRPKP | 57 |
| 233 | MSRDQVKV | 8 |
| 234 | MVNGPTHAVDAGRQEGLCCGGNHLNLSLDLVLVPACKASDDATK | 44 |
| 235 | MVVNVRACQRAQLHEGHLDIMTPSDLPH | 28 |
| 236 | MNEPLSAHEVRHSGYASLEHHERTEYGEQEFGDVKD | 36 |
| 237 | MDRACKEDDGIAASPNIKRGDPHLQVRLGPGDKIL | 35 |
| 238 | MRSGHRRRTEDHQVL | 15 |
| 239 | MEVDQSSGQSR | 11 |
| 240 | MVYPGHVAHLVSGSWDGQTRQQS | 23 |
| 241 | MRQGPGSAS | 9 |

TABLE 2e

(Seq. ID Nos. 242-288)

HCV 2a ncOrf's 1-3
Genbank Accession No.: AF238485

| SEQ ID No. | Sequence | AA |
|---|---|---|
| 242 | MTPGIGRVTWVRSSIP | 16 |
| 243 | MTVPMTASPGSFRRRSSTSPGASRAREWEIHHGAGYRSHQMWLCSSAAPSRRACGRTSTWS | 61 |
| 244 | MAVGTSTAPP | 10 |
| 245 | MPARTFCAPRTVLGSILTPLTSNVVLGPGSRRGAWSTTLTGSGTTPAQLTIPSSR | 55 |
| 246 | MACHLPLQNMSFDGSG | 16 |
| 247 | MASYILSSFSWLLGTSKVGWSPWPPIPSPAYGPFAYCSSHCPNRLMPMMHLCKGS | 55 |
| 248 | MALYGLPPYSARVWCLT | 17 |
| 249 | MTTSPLCRIGLPTACGTWRSL | 21 |
| 250 | MDSPCPPDSVGRFSLAQLTATPPRGGSFSPPSPLTPSRHEVSWAP | 45 |
| 251 | MLRPAVEKAPKSLSRTLPRGIKC | 23 |
| 252 | MASIPTLGLESEL | 13 |
| 253 | MANSSPMGAARAAPMTSSYATNATPWTLPPSSASEQFLTKQRQPESG | 47 |
| 254 | MGERFPCLTSREGDT | 15 |

TABLE 2e-continued

(Seq. ID Nos. 242-288)

HCV 2a ncOrf's 1-3
Genbank Accession No.: AF238485

| SEQ ID No. | Sequence | AA |
|---|---|---|
| 255 | MSSRRPFGAWAMLWHTTEGWTSP | 23 |
| 256 | MFPLVSEPQGCLIAWCSVSATTQGLRGMSLRQRRLP | 36 |
| 257 | MPTSFPKQSNRGRISHT | 17 |
| 258 | MRLLMKWRNVPLKRLSLKRGSGWPRC | 26 |
| 259 | MARAFRGPSSHSRSTLARSPPWRTSSICCLGFCLRVPWWWESSARAFCAATWGREKARSNG | 61 |
| 260 | MCGTGFAPS | 9 |
| 261 | MRSRLPLGSIHL | 12 |
| 262 | MMWTWWMPTCSWGAM | 15 |
| 263 | MPSSSWPSKPSASPLQAAIQASLQGRTPPTPAVGRPLMSWPFRRQVLPPPCPPSRGSLGIQTWSPTR | 67 |
| 264 | MTPSCAAPCHTPGPGP | 16 |
| 265 | MDMGPRRFAACPGGPLTTSSPCGRTSWKTHKHQFLRPSWPKMRCSAWTPPRGVRKQLALSFTLTSVLGSARRWPFMMSHKSFLRQ | 85 |
| 266 | MDSSTPPPSGWSFS | 14 |
| 267 | MTPDALTLPSLRETLELRRPYTRLAPCLRRPVLPYTR | 37 |
| 268 | MTWLSSQKARGLRRTSGT | 18 |
| 269 | MCLWHSAYRAAADTT | 15 |
| 270 | MLQLYGSAWS | 10 |
| 271 | MPGHLGVPPQDG | 12 |
| 272 | MAPVPPRFSSLLGPQ | 15 |
| 273 | MQLLHLPGYHHWASYGVGHDDELVTHYHHDPGLRDARPRGHHRHH | 45 |
| 274 | MGHFAIRG | 8 |
| 275 | MWHSPREVRVRPSVLFHPQPSRGGHDR | 27 |
| 276 | MVRLHVDELHWEHQDLWRATLPH | 23 |
| 277 | MWFWALAHAEFPGRLPLQALALPLHS | 26 |
| 278 | MGHLALLFLRLARFVDWSTPPPPKYRGRTIHVWPVTCPYKICRSMGVGSALIPSPSGRQGLRLRVDAYLAGPGRGSTREAGRLARCERS | 89 |
| 279 | MALLPTAPRTAPTGLCL | 17 |
| 280 | MGYHHILPGCGV | 12 |
| 281 | MRGHLTWTPRVRPTRSGDSPWPS | 23 |
| 282 | MDRLPRSWQ | 9 |
| 283 | MRRMPRRGRYHHPRHRNSS | 19 |
| 284 | MAQSGAILGQTHVELH | 16 |
| 285 | MDEQAHSLCFQRKPRRPYPLRDGVGCVAACDPTAWLPYYN | 40 |
| 286 | MLCEGPSGLQSCGDSCAHNAGMRR | 24 |
| 287 | MVGKHHPVCSNYMGPHGPDDTFFLHPYGPRHSGPGP | 36 |

TABLE 2e-continued

(Seq. ID Nos. 242-288)

HCV 2a ncOrf's 1-3
Genbank Accession No.: AF238485

| SEQ ID No. | Sequence | AA |
|---|---|---|
| 288 | MSVVQPPGPPLPGEP | 15 |

HCV polyprotein

TABLE 2f

(Seq. ID Nos. 289-359)

HCV 2a ncOrf's 4-6

| SEQ ID NO. | Sequence | AA |
|---|---|---|
| 289 | MCHQDHADPYSWSILDDVSQP | 21 |
| 290 | MGWSQLARLLQGEELCADLGGR | 22 |
| 291 | MDLHSVHPGEKLWRG | 15 |
| 292 | MGRGDVVSSGSKGYEPVHPLDRAFSRPHVAAQNARADDSHHQGTRRQNPRQQIDDVLHGGLLARHDLECDEGPRNARAIPRQDIHQHLAQAYAAYSSPH | 99 |
| 293 | MCESDLVGNRAQTV | 14 |
| 294 | MVLAHGQARRVEIRSKPYGSLRWRKLIPRSPCVVALTEHHAIKHP | 45 |
| 295 | MAEDQVSPSLDVRQGKRSPIEGDLTLLPEGHLLYIGMGGRHRPRGSGRGQYS | 52 |
| 296 | MCLGQIRPKPQGGSHRGIKH | 20 |
| 297 | MQVPDLVGLGHSWWCAVVTKGGRPDDVECENGDEVYGLSHAPRAHSCPEDPDSVAPGAKHRSPRGPLQSRKRSRGE | 77 |
| 298 | MLPKTVRGAQKVRAGIEVGSNAARWRATSLGETSGVHPRAAEP | 43 |
| 299 | MRDSTPNSGGSRVHSSGHQKDDNDLGPRSLHREVGQAEHNAPMSSTNDVYDDLGDAHHVSQDHGGSG | 67 |
| 300 | MPSDGTQVDGAIAFLHKPVVLRRDNEHLGCQHYPAAEVPHVESRAERSGHHDHVDVRPQALREGAALLHSHIW | 73 |
| 301 | MRESSGNATKRGAYDGDVPHEVGEAAR | 27 |
| 302 | MPGVIGAPRGTRTSGGQEPSCPAESLVPV | 29 |
| 303 | MCAEGRRQARVTFQLWLGGPEDSRSTPIRTFQN | 33 |
| 304 | MLSAPGHIPVWGGHQEGRNTWS | 22 |
| 305 | MLSRETPPAGRGSTGIHKMPPSLPEEAFV | 29 |
| 306 | MTWSSTRRSHPPRSK | 15 |
| 307 | MVLRARGRSFLRPSGRESPERPLWTQTLSGSHRPP | 35 |
| 308 | MAPIAGSPRSLPQMGVTPALSAALQPPP | 28 |
| 309 | MDLLAWTSIHQYRAQGHKEAETRLQMN | 27 |
| 310 | MRRGPPKCPRHTPPGYPPAPCPGLCCLQQPPLGH | 34 |
| 311 | MPSWKPQQDSLVVLTVLRGTECR | 23 |
| 312 | MKPPQRVVCPGPV | 13 |

TABLE 2f-continued

(Seq. ID Nos. 289-359)

HCV 2a ncOrf's 4-6

| SEQ ID NO. | Sequence | AA |
|---|---|---|
| 313 | MRRRLPRPPQLGPTCWS | 17 |
| 314 | MWRCILSQDV | 10 |
| 315 | MRNSPPIALFGKGSGHLCV | 19 |
| 316 | MPQHSSPCPEGPPRAHHTFSLNGRRSSVSLP | 31 |
| 317 | MWSTLWPPRSSQF | 13 |
| 318 | MRPSPPPRR | 9 |
| 319 | MHHRHKPVGAVRGAVGKRAIGR | 22 |
| 320 | MTPAVVGCCSTGKHLSHSPPTCKWALQVYRSCPPRLGWG | 39 |
| 321 | MASYLLDW | 8 |
| 322 | MYFPLSRTGRTRGRGGPPPEAAR | |
| 323 | MALPGGGGLEAVRHSY | 16 |
| 324 | MYPMRSAKPHVRVSMTLPTLRDLCRGSLGPQEGREPRGDRSHPAQPSPSFPYRGQGYPGFPQDLPVERRSLGMGWRLPRGWDRSEVFLVVRTPNLGPLRGNKYTPPTIWPPPGNLTSCGRRLVFLLVFL | 129 |
| 325 | MSPPPAPTVNQLDKSRRRASGNGVSLSLVFTAQLKRYRPQTAALPPREMRDALTARARLFHALRGGAPSFLRAEATRVSSWGVYVCRRKASSPCNLSIMAGRSRGLTEYTDPYISKLRSWSRVSWAIRMEKKCVIRTMRTHIVGAYWMMFPNHELTGECLTVSQAARAIGVVGSLVR | 177 |
| 326 | MTTKSSPHTSIVGATIPAALQAARAFT | 27 |
| 327 | MVFPMLVVSTPLARQRLYPQVWPLLLNIGPPT | 32 |
| 328 | MAVRASSGKEQAWYMASSVLMSLSVTVSSKHRVSYEKPIGSFLSAHAFKRNSTRWAGEYWNP | 62 |
| 329 | MMVVGIGVCESSRRSFHTDLMWLTALPDKLRTSLAPYPYLDLAEWGGVNWHASSKVRSFALTLEAASLMSFKTES | 75 |
| 330 | MEQHTTESSSSEQVDQDPESEPGAASPPWEGGRSSTWSGSRSGSPGSPSRGGMEEVEPVSERANSSGGVRPPESAASAPVERPESPLGGGWPKVLMASCWRASPMVLSLRPTVRRLLGGGVGVFLGGGRAQPATVGGW | 138 |
| 331 | MNRLASTMSTS | 11 |
| 332 | MDINTSVSGSGSQGS | 16 |
| 333 | MAVLKFGAGFGMHWPSV | 17 |
| 334 | MLAPQGHRVVMMPVPAHTPL | 20 |
| 335 | MVQTQSHTSRSHEPAHGMGQSSVIQLWSLLSRLVIVREPSSWVTRCDASDSVT | 53 |
| 336 | MSLFIHWTAPSPGPTWRRRMPAQMTPTTRAPGDKIPGSRLMTSSMEGFSPDMILNATRAPEMPAPYPARISTSTLPRPMLPTAAPTRPLTTKPVAPAGGAIWDASQPPRMLRRIVVLVDNGLVRAALNAIMEATAGFPGSVDSPARY | 148 |
| 337 | MPLMKFHMCLAQNCSTLGHEASTAGCMSWACLEACCNKPWILDFSISAIRCPSSMRAALEAHSSISSKAS | 70 |
| 338 | MCKRPMMETHPVAKQYAATAAKTPPARTHVLVMTSRSACMHVAMYFVTGCVKVTSLVTEPKRYRRGVGPTRVGLSRVRHEHMTSQDGGGALALAHTVA | 98 |
| 339 | MCVRPVKTASQNSRWSWHTGKPGVLKYALSLTVVSAGVSSYHAAPAS | 47 |

TABLE 2f-continued

(Seq. ID Nos. 289-359)

HCV 2a ncOrf's 4-6

| SEQ ID NO. | Sequence | AA |
|---|---|---|
| 340 | MRASVATTTTSP | 12 |
| 341 | MPRRAAASSSHFFFEWQKIKCLPPLM | 26 |
| 342 | MPRMVVASTAWHSSHMMMS | 19 |
| 343 | MAAPVVTVLTPVLMLGLMPCALDKYAPNPRVAATEGLSTSTLYPWAAYATGTLVLFPLPVGACKYRTW | 68 |
| 344 | MSSASTGMKSMDLATPREHTAARKIPTAWPLGQSTGPPEDPFKVERGLGESNAPRLSPRLRAGMTSAFRVTRYRSTAPHEHGSKDLVPGGLGHPTKSPSALEYICVTGPREPARVLLPAPW | 121 |
| 345 | MDVPRKDWVTVDRTWISPACSVLSRPVMLTTMAPKRPRVCWA | 42 |
| 346 | MGARSFHPLEV | 11 |
| 347 | MSPHAAVSAPQTMTFFSIGLKMIGSTATAKSRRPLAAQSDIGARWS | 46 |
| 348 | MSNTTPGQNMVVAHIMPSRPPRACMGGTHS | 30 |
| 349 | MASPRVRR | 8 |
| 350 | MYQAATKKMTKYRKPLQLAALAACKTTSFSSAASAWPSKISIHTQAQTLASARRRNKSTTHSHRTTYFVRAGDRPYMYCTSTIFWWRWSRPVDKAGKSEKEQGKMAHSVVECNRGDSWLLSLSSKSQRSPRVKLHAAVSLCSIPPTYILILKME | 154 |
| 351 | MRQGGAPQVLVKPVEFIHVQPNHDPRGGRVLFNRKTSVSPSPHV | 44 |
| 352 | MCQLPLVLISWMFCLEPGERRPAKLSVL | 28 |
| 353 | MTTTLAHAPCIEK | 13 |
| 354 | MMSMMTSGTRIT | 12 |
| 355 | MVVVGDQFIIMSHAIRCPVMVPRMEQLHSCTNQWCSGEIMNIWAASITPPQRSPT | 55 |
| 356 | MSMCVRKPCVRAPRCCTATFGETGIQHRDVFPTLSHGTHPGTWRTAA | 47 |
| 357 | MLSLEQSLVTM | 11 |
| 358 | MVIQDSRASKKIEKEQPGRFPVA | 23 |
| 359 | MYPMRSAKPHVRVSMTLPTLRDLCRGSLGPQEGREPRGDRSHPAQPSPSFPYRGQGYPGFPQDLPVERRSLGMGWRLPRGWDRSEVFLVVRTPNLGPLRGNKYTPPTIWPPPGNLTSCGRRLVFLLVFL | 129 |

TABLE 2g

(Seq. ID Nos. 360-404)

HCV 2b ncOrf's 1-3
Genbank Accession No.: AB030907

| SEQ ID NO. | Sequence | AA |
|---|---|---|
| 360 | MGATLRHESLPCEELLSSRRKRLAMALV | 28 |
| 361 | METRVAVGQVGSCPLAGLVLLGAPATPGIDHAIWAGSSTPSRVVLPISWGTSLSLAPLSEASPELWHTVLGSWKTG | 76 |
| 362 | MQRGIYPVALFLSSYLLFCRALQCQCLQWKSGTSALATTPLMIARTTASPGSSLTQFSIFLDVSHARMTMVPCAAGYK | 78 |

TABLE 2g-continued (Seq. ID Nos. 360-404)

HCV 2b ncOrf's 1-3
Genbank Accession No.: AB030907

| SEQ ID NO. | Sequence | AA |
|---|---|---|
| 363 | MRPPIPPARQWAGPLGALLASLSLVPNRTSN | 31 |
| 364 | MTACTRVSWPPCFMPTNSTALAAPSVCLPAVGWMIFVSGGEPWNTRPTSPMLKT | 54 |
| 365 | MLPMLSVEQGPG | 12 |
| 366 | MDFLQLLRNTS | 11 |
| 367 | MGRCGSSSFLRRPGT | 15 |
| 368 | MTTSPPCQLGRPRVCGTWRLPWSLSCSAQWRRRSSCGGLRQWHVETSCMASREPRG | 56 |
| 369 | MATPPRGGSS | 10 |
| 370 | MSRPGRSRFCPPSHNPSWGHLERGFSGRYITGLVTRPWLAPEDQSPRCTPAQRGTSWDGLVPPGLSH | 67 |
| 371 | MIDGVHCCRQGLSQPSKDHPEDPCSALGDTPWACSERPCAPGVWPNLLTSSRLNLSTSLDGRPVFLTTARHQLCPKLTRWATCTHRQVAGRAPRSLPHIPVRGIKCSC | 108 |
| 372 | MASFSRMEAAQPAPMISSSATSAIQWTLPPSLASEQSLTRLRPQVLGWWF | 50 |
| 373 | MRARSLFMARLSL | 13 |
| 374 | MSSQQPFGAWASMPSPTTGVSTSPLYQLKGT | 31 |
| 375 | MSHQAKGRLGCSTA | 14 |
| 376 | MMPGQLGTSLRLLRLR | 16 |
| 377 | MPTSSPRRSKEEITLRI | 17 |
| 378 | MIRWLWPLTRKSYMRPLMRWKNAPPKPPSLRKGSGWRRCLNLRY | 44 |
| 379 | MLPLLTTWRSLTPRCA | 16 |
| 380 | MIVTWWMPTFSWEAM | 15 |
| 381 | MIVSLLYHQST | 11 |
| 382 | MWRGSLGRWQTKCSALSKTPMTPVTPLGRIPEETASSSPLARLPLQMRDHCPPCLPLRGSRGTLTWSLSQRDPLPLPRGSVRSSTRTLSRGLQSPIKRILLSAAPCHTPGQEPS | 114 |
| 383 | MTQSCRTLSGLPLRLVRGSSQ | 21 |
| 384 | MRCSVLIPPRAEKSQLASSYTLTLGSGCAKRWPFMTLHKSFPRQ | 44 |
| 385 | MGSNTLLQNGSIFSSKLGEVRRTQWGSHMTPAASTQPSRRGT | 42 |
| 386 | MGLTPSHCTHTLPTNSHGWQRLSGNLERLPLERGRVGRVL | 40 |
| 387 | MPDPAYYSPAYSYLA | 15 |
| 388 | MNHSPVRNYCLHAESV | 16 |
| 389 | MSGHLGVPPQDC | 12 |
| 390 | MGHDAELVTNSYHDPRLRCSCSRVGPGNCLRRPLGCGIWLGLFLHAGSVGQGHCHPPSCCGSGCDHLFHRRDSGPDRWELCWPL | 84 |
| 391 | MRYRPSSVGLRAGLLLYS | 18 |
| 392 | MRSTTLPH | 8 |
| 393 | MHRKFHHLQGADVCRGGGA | 19 |

TABLE 2g-continued (Seq. ID Nos. 360-404)

HCV 2b ncOrf's 1-3
Genbank Accession No.: AB030907

| SEQ ID NO. | Sequence | AA |
|---|---|---|
| 394 | MQFHTRRPLQIGR | 13 |
| 395 | MLLLRPTGTIYWPVAPSPKHRGRAVPLWTFSSCYEIHRKVGMGGPPFPVAGRRQDLCMPLDAHHTGPS | 68 |
| 396 | MGSPPGGPRGA | 11 |
| 397 | MWRHPAWPPGFREAR | 15 |
| 398 | MGPGWGGASRRGSLLPGDRLHLHHWPHTPE | 30 |
| 399 | MRLQSRPH | 8 |
| 400 | MAQDRTILGQTHVELHQWHTVPGGTLHLTGKSRSGINDGFQRRIN | 45 |
| 401 | MFGVLAPGHLGVGMFHSHRL | 20 |
| 402 | MRSKHLGPRPLGHHENNRPEDLPKHVAGNLPHQLLHRRALCAKTPS | 46 |
| 403 | MWARGGEVANQPSE | 14 |
| 404 | MSVVQPPGPPLPGEP | 15 |
| | HCV polyprotein | 15 |

TABLE 2h (Seq. ID Nos. 405-479)

HCV 2b ncOrf's 4-6

| SEQ ID No. | Sequence | AA |
|---|---|---|
| 405 | MRLTDLSQLAVTRAKMEPPRKEEKKKIRKKRKKKKNKKKKKKKEN | 46 |
| 406 | MCAMRRRQAHVAFQLWPAGLVD | 22 |
| 407 | MSWCSPCW | 8 |
| 408 | MRTPLGPSYFPKL | 13 |
| 409 | MSRSQEGCSLDGPREVVPVGTFSSWSSTLMVQKAHDHPLPQSWNRGSQERSPWSRTQFGSHRLP | 64 |
| 410 | MPFYGWYR | 8 |
| 411 | MPLRDFPVRWRVPPGTVCH | 19 |
| 412 | MMTAWLAVCPGPVLWPVVGGLVS | 23 |
| 413 | MRHTCKCPIAPSQFSLYVDYGRQRPEGQSEW | 31 |
| 414 | MRQGPWCSSRYLSVRAGSPPGKFGAQLVACCCQKNWASV | 39 |
| 415 | MHPVYHLSSGPE | 12 |
| 416 | MPLSQPPTR | 9 |
| 417 | MAPVVETL | 8 |
| 418 | MWPRGPLCPLSTRPP | 15 |

TABLE 2h-continued
(Seq. ID Nos. 405-479)

HCV 2b ncOrf's 4-6

| SEQ ID No. | Sequence | AA |
|---|---|---|
| 419 | MHRSWRLPATGKGGPPIPTLRCIS | 24 |
| 420 | MATPPTQWWSAAVDSADPYPYLPICSGLRV | 30 |
| 421 | MLQRIYAPPPLHTSAP | 16 |
| 422 | MDNATVCKGSLSGTWGSTRALLHT | 24 |
| 423 | MALGGNASSTASCLQHW | 17 |
| 424 | MGHIQEDGELR | 11 |
| 425 | MALPGGGGLEAVRHSY | 16 |
| 426 | MICRETSYGTLCSHAAHGPFTASRD | 25 |
| 427 | MPTPTLSRSRQRSNRRGRACDTL | 23 |
| 428 | MSPPPAPTVNHPDKSRRLASGNGVSLSFVFTAQLKR | 36 |
| 429 | MMSEALTAPARLFHALRGGAPSFLRVAIATRESSWGEYVCNEKASSPCSLSIMAGRSSGLTEYTAPYISKLRFWFRVSWASSMEKKWVIMTIRTQIVGAYWMMLPSQELTGECLTVSQAARVIGVVGSLVKKYRRRPRESSATDTFEEQDVISSKSYSGLGRSPGGAEYLVIASVKALRFRSSSSLPWLSEMTTRSSPHTSIVGSTIPAALHAARALM | 217 |
| 430 | MVFPMLVVKTPLARQRL | 17 |
| 431 | MDSSVLMSLSVTVESKQRVSYENPIGSFLLPQALRRKSTRSAGEYWNP | 48 |
| 432 | MRRAGFFPPLAGSIQNTSFLAMAVVSIGVCWSSRRSSHTDRMWLTAPLDKLRTSFAPNPYRDLAEWGGVNAQASSTERSLALTLEAARLTSCKTES | 96 |
| 433 | MRAPVQEYDMEQQITESS | 18 |
| 434 | MTSHSPSEGGADLAGSNSRSGSPGSPSRGGMEDSDPASEAAVSPEGCWTLSPPVSAPVE | 59 |
| 435 | MESRESRTITLESDSIRVTSPPMKRLASTMSQSYAVLWVVQVAFKDGADSWLAEELACEGGDPLASRLAAVSAVMWDGSVNMEANTSVSGSGSQGS | 96 |
| 436 | MGKVPCHMFRQVFGPVIFMVPKRTWPEMFAPHEHRVVMTPVPAHTPLYPFWQEMKGRPGILGSNFADSQFLKSVRMEHTHSQMSRSQDPEHGTGQSSVIQACSLLSKLVIVSELNTCVTRSEASDSAT | 128 |
| 437 | MTPTTKAPGDKIAGRRFTTSSTEGFSPLMILKATRAPEMPAPYPARTSTNILPRPILPTAAPTRPLTTKPVAPAGGAIWEANHPPMMFKRMVVLVGSGLVNAALKAIIDATAGFPGKVESPARYCMPLMKFHMCLAQNCSILGHDDCMAGCMSWACFVACCRRPSILDLSISAIRCPSSMRAALEAHSSISSKASYKISLSGATTT | 206 |
| 438 | MRPMMEMQPVARQ | 13 |
| 439 | MTSRSACMHVAIYFVTGWVRVISLVTAPKRYRRGVGPVSVGFSLVRHFHITSHEGGGAFALAHTVA | 66 |
| 440 | MCVRPVKTASQNSRWS | 16 |
| 441 | MVKVGSRLKSTI | 12 |
| 442 | MTESKSPVYPVIRASVATTTTSP | 23 |
| 443 | MPRRAAASSSHFFFEWQNIRCLPPLMEARGIALP | 34 |
| 444 | MLAWGVVTVPGGVAVARTTSLTPAVSAWSRTVPMPRMVVASTEWHSSQMMIS | 52 |
| 445 | MLGLIPWALDM | 11 |
| 446 | MSRDSTGMKSIDLATPLAHTAALNKPTACPLGQSTGPPDDPLRVERGLGDSNAPRLSSFLRTGMTSAFRVTR | 72 |
| 447 | MAPRRPRVC | 9 |
| 448 | MGAKSFHPLEV | 11 |
| 449 | MSPHATVSAPHTMTFFSIGLNTTGSTATARSRKPWAAQVDKGERWS | 46 |
| 450 | MVINSIWIYLAPARCLTRVHTRSRA | 25 |
| 451 | MTATQMIPSRPPRASRGGTHC | 21 |
| 452 | MDMTINMTSPSSPCSAASKA | 20 |
| 453 | MKNHSGPLALAALAECKMMSFSSAASAWPSMMSIQRHAQILASASNRKRRTTHSHFTMYFVTAGESP | 67 |
| 454 | MVKFTVHG | 8 |
| 455 | MRQGGAPHVLVNPVPFIQVQPNQAPRGGLVLFSRKTSVSLSPQL | 44 |
| 456 | MSSTLVTLVSYSKVPHPIRKSSSPRQEDKRSGQPELLNLLA | 41 |
| 457 | MKPVCKLSLQLRAVRFMCQLPLVLINWTECWAPSLKRPAKLPTVRPTVAPVE | 52 |
| 458 | MAMTLAHAPCMEK | 13 |
| 459 | MVRVGDQFSIMSHAMRWPVI | 20 |
| 460 | MEQLHSWVKLWRSGDTIRACDTIITAPHTSPTYRAEQTVAAITITSTCARRL | 52 |
| 461 | MLLFEQSLVA | 10 |
| 462 | MFLISTEDTGTVTHDRRASKKIEKEQPGKFLVA | 33 |
| 463 | MYPMRSAKPHVMVSMTLPKLRDLCRGSLGPQVGRDPRGDRSQPAQPQPSEPYRGQGYPGFPQDLPVERRSFGMGWRLPRGWDRSEVFLVARTPNLGPLRGSK | 102 |
| 464 | MRHAVKDVAPAGAHGEPPG | 19 |
| 465 | MLVFQEVLPHGPDVVNGPPG | 20 |
| 466 | MEPHKRVTQRADWQLLLLGPTWCYEGSCPGV | 31 |
| 467 | MGGTGSLQGRGGQLAR | 16 |
| 468 | MLRDLNVLRRCHPPNSGLIIRRGFWHTRPFCVTIDGEGSLPHV | 43 |
| 469 | MVSPRGKGDQSVHPLDRPLSLADVAAQDCCANDSHYQGARGQNSR | 45 |
| 470 | MGQGNLVGHGTQAV | 14 |
| 471 | MTKGHLLYVSVGSCHRTGGRGCG | 23 |
| 472 | MALVADDDIIGAG | 13 |
| 473 | MQDVSTCHCLSPPHDDLLLHWAEHDRLHGNRQVPQTLGRPS | 41 |
| 474 | MSHQGTHS | 8 |
| 475 | MLHPPYIHPHLEDGEIYGAWIMPQSVRVVYQAPGGQPGPCSTLNIGSIWVLPKTVCRAQ | 59 |
| 476 | MPAVRPHVFNIGDVGLVFQGSPPDTKIIQPTAGRQTLGAARAVEFVGIKQGGHETRVQAVIAVEGGPVYVPAAVGID | 77 |

TABLE 2h-continued

(Seq. ID Nos. 405-479)

HCV 2b ncOrf's 4-6

| SEQ ID No. | Sequence | AA |
|---|---|---|
| 477 | MAAEDNFQDQLGNTSSVGEDHGKSW | 25 |
| 478 | MTLVDGTVALLGKVVAFWRYYKSLRHDHHGPTHISHVQSRADRS CHYDHIDVCSQVVSECTAVFYSHIRCYLYPAAQGTIVILAWDTS RKMENCVSELPGDAVVRAIISGVVASADVPDFH | 122 |
| 479 | MPGVAGAPSRTRPARGQEPTCPTATLVSIQRPRISWLSPGLAGG APIFRDGLASPTRLGSLGSLPCRAHTQPGAPARQQVNSANDLAA TRELDVLWAAVCVSFGFSLRFRICAHGARSTRPPGALASTLSGS TTRPFATQRYSASSLAGARPNDRT | 156 |

TABLE 2i

(Seq. ID Nos. 480-517)

HCV 3a ncOrf's 1-3
Genbank Accession No.: AF046866

| SEQ ID No. | Sequence | AA |
|---|---|---|
| 480 | MALVRVSCSLQAPPSRESHSGLRNR | 25 |
| 481 | MVMRAAGGQGGSCPRAAPVHLGAQMTPGGGPAIWVKSSIPLRVD SPTSWGTSRSSAPPWEASQEPSRMA | 69 |
| 482 | MRPMTSFCTHPAAYLVFRTTIYPRAGPQ | 28 |
| 483 | MPPEGLLAFLVWAPNRNCSWLTPMARGTSTALP | 33 |
| 484 | MLTSPVLLMTNRTAGTTHLDLVKLSRHQVSAVLYTASHHRQWS | 43 |
| 485 | MPRACQPTPGVRMIPMCSCWSPCGLPVVGGLGARG | 35 |
| 486 | MGVGGIPEMSQTSSAPPTASGNTLRPHTAGVVRGPG | 36 |
| 487 | MSNTFMALDLAWWDGR | 16 |
| 488 | MRGRVKTALLSALGSWPSSASLPYHPGTSIGSAALYGGTSTPYV DASPPSKCGSPPYLHAGVGTVSSC | 68 |
| 489 | MTIGRWVGDCWPRSQHTPSKLGAFLGLL | 28 |
| 490 | MVQVRERSRAPNIPRSKCTQM | 21 |
| 491 | MPMSSLLGAGGTPQRACSVLDLSPVSKVPLEVLLCALRGMLQGS LGLLCAPEV | 53 |
| 492 | MPRPAAVKAQRSRPLTWHKDILFSC | 25 |
| 493 | MGSTPTSALGTAPLQLVPN | 19 |
| 494 | MNVMPKTLLAYWVSARS | 17 |
| 495 | MCPSYQQQETS | 11 |
| 496 | MRFPAANVVAVRAEVDSVHTDMSPPVKDRLECLTRLFSVSAMTR AARGTISSPLRPQSD | 59 |
| 497 | MPTFCHRLSSRDLTSRT | 17 |
| 498 | MDLRPFYTGWGLSKMKSACHTPSQNTSWHACQLIWK | 36 |
| 499 | MRWRSAHKPPRTSSKLRQ | 18 |
| 500 | MELVSQAPWWLLRSWEENSPPLRTWSTCCPPYYLRVLSSSV | 41 |
| 501 | MFPRAMLQRGSPHC | 14 |

TABLE 2i-continued

(Seq. ID Nos. 480-517)

HCV 3a ncOrf's 1-3
Genbank Accession No.: AF046866

| SEQ ID No. | Sequence | AA |
|---|---|---|
| 502 | MKZTQALVVTTGCVSSGTGFVRCCPTSSHGSLLRLCQRSPGCPS FPVKRDTRACGGGTA | 59 |
| 503 | MGPCGLQGRVHVLTCGTVLSPSMSTPPDPVHLVHHPTTLARYGA WLPTATLKCAEWGTSIILRGPQKMSSSVRAKYRLLSSSLKWMG | 87 |
| 504 | MTPSSRWLQSVSRNLPSILQPELSGLGQTTILHCWTAGKLRIMY HQLSMDVPYHHGALRRSLLLGGKEQESWTVPMCPRRYVR | 83 |
| 505 | MTPAALTQLSLNRTSGWKRRYTNAATLNRRPGK | 33 |
| 506 | MIWSWWPRVTASMRMGQP | 18 |
| 507 | MLHSPPTTLSSSHLAPPTSPWHGTTRGGGTITSPVMPPLP | 40 |
| 508 | MDHSPVRNFCLHAESA | 16 |
| 509 | MPSKAQQLQAHHELQAGVGSLDRC | 24 |
| 510 | MYSQFHIVQGEDVRGWVRAPVYRRLQLDQGGALRYRRS | 38 |
| 511 | MGAEMGVRHPHFTPPSGPTRVRCPLADADDNTSRSSLGEPCHAE RRRCWDTRYRLVPGGLLCGVVRAGQTCPGGDLQPDGPLAPSFA RPHAPPTGVCVVG | 101 |
| 512 | MVEPVHHM | 8 |
| 513 | MRVRPPSVGPPLTCTRE | 17 |
| 514 | MRCHTTPTRRTWGGGGTVDEQAHRIRIPGQPRPTNALCSRERCC SEGHRIAEFSNCHKPAPAVTPVDQ | 68 |
| 515 | MARGCQQLR | 9 |
| 516 | MCLTTTGRSAGPSSSEEKNNSAGRFQCVRGVTCASGKIISVLET AGRE | 48 |
| 517 | MLIHASSRGRTGRSGLELRLLVHR | 24 |
| | HCV polyprotein | 15 |

TABLE 2j

(Seq. ID Nos. 518-587)

HCV 3a ncOrf's 4-6

| SEQ ID No. | Sequence | AA |
|---|---|---|
| 518 | MESFNDCW | 8 |
| 519 | MVVEHLQSVEGNLPLTLRSASRRR | 24 |
| 520 | MMSQQGVAEWADGQFLLLSTTRCYQGAGPRVRHRAADHALLLAV TNGGPRVATQVRIARFSLERRHG | 67 |
| 521 | MDSWWYIIRSFPAVQQWRIVVWPSPDRKGWRILGRFLETLCSHR ELGVISFGPQRFE | 57 |
| 522 | MRPMRLASGLQRRS | 14 |
| 523 | MRRVSQHRGQHRNIWFWLTGELRSYRVGIQPYRESDLLS | 39 |
| 524 | MEVPHSAHFNVAGGSHAP | 18 |
| 525 | MTGYCCPARTACRHHAVPPPHALVSLLTGNEGQPGERWHNLSRE P | 45 |

TABLE 2j-continued (Seq. ID Nos. 518-587)

HCV 3a ncOrf's 4-6

| SEQ ID No. | Sequence | AA |
|---|---|---|
| 526 | MGGNPPPEYVEKHSLVGRQGTGD | 23 |
| 527 | MLVPEGLKLLPVGSYYGLNDSLLLGGSLQQSKDFFLELVGYCLSLLDVRGGL | 52 |
| 528 | MTHNHNAAD | 9 |
| 529 | MAKDKVPPPLEQGYRYSLTVEGDLTFRAQGHFFDVRMWHSDAAWGSSCR | 49 |
| 530 | MTFITDNHIVCPPGATPVREKLTVGGIGQFGTSCNGAVPSADVGVDPIGTRHERAKA | 57 |
| 531 | MKVSYLIALWNSRRS | 15 |
| 532 | MPRPAHNRTSRGTFETGERSRTEQARCGVPPAPSRDDIGIAGNQV | 45 |
| 533 | MFGARERSRTCTMVNSPRNPPHCCT | 25 |
| 534 | MQQWMLLAAVTIFDIAALPPGPVASGGKPVLEPTHEHPHLEQCEIDCTWVMPKPVWIVDHAAGCQPGPRTTPAVCGLRMFPEAVGGAEEV | 90 |
| 535 | MIIKQPSYEPGVYGLITVQGSAVDVPRAIGVNQLQFLLGAHTKKASKPSGGMSCRATGGICYGIDP | 66 |
| 536 | MGPGYYVEQGLGHPQDVRHRHTQSGEPIHHHIPSHSMS | 38 |
| 537 | MTTYRSGGCSDVPDCHCRCHWGPARGYIVVLNTRYAAGCVQNDVIGLIHNTAIGTVVGEDVEARRIPPL | 69 |
| 538 | MREGSCDASHGGADERDVPHEVGESTRKGIDDFTQIAGPPPGVIWAPRWTGAARGQEPPCPPAALITIEGPRVPGLSPGPASALTRLGDRLSSSAGL | 97 |
| 539 | MARRFPREDRSSSQGSDPWWSVAS | 24 |
| 540 | MSMTLSRTPLPGRGAPWK | 18 |
| 541 | MIFPLAHVTPRTHWNRPAELFFSSEEEGPAERPVVRHIHGQLVVHNPELSSGPTVEDCSLA | 62 |
| 542 | MNQESQPLFQTPPV | 14 |
| 543 | MEGTHAQGGALPSRR | 15 |
| 544 | MEGRNGGVSPHPLQ | 14 |
| 545 | MDKVYWVRWCTH | 12 |
| 546 | MYAALQAAWTHSSHDRLLLPRKDSVSTSRRPPATRPCIPFDRK | 43 |
| 547 | MYRVYLCPYGHDVGCGKPHLGEQCGSRWKRWGPG | 34 |
| 548 | MPPRSNPRPRETYRRWNRSVWHQL | 24 |
| 549 | MDSAREQYILVPRKRPGPLCFYRCRSGHEGILPDSSVEQQEELNCQRKMGT | 51 |
| 550 | MMDKAGLLAG | 10 |
| 551 | MGNAKAGMDSRPCSGVSTRAPHHTGCMWPQDVS | 33 |
| 552 | MPGQLYKV | 8 |
| 553 | MLRHRPLKT | 9 |
| 554 | MDGSRAGTGATLPTRSPHYRGAKGTRAEPRTGLRSDAPWG | 41 |
| 555 | MALPGGGGLEAARHSY | 16 |
| 556 | MPTPTVSRSRQSSK | 14 |
| 557 | MSFPPTPTVNQMDKSNWPARGSGVSLVLVRTAQLKR | 36 |
| 558 | MIAGKSSGVTE | 11 |
| 559 | MEKKCVIITMRTQMVGAYMMMLPNQELTGV | 30 |
| 560 | MSCSVTVESKQRVSYENPKGVFFEVHILSRRSTRC | 35 |
| 561 | MMVVGIGVVVSSSKKSSQTERIWLMALLDKERTSFALYPNFDRAE | 44 |
| 562 | MVSMRAFTLDARSFTSFNTVL | 21 |
| 563 | MGSFSSSALHGVIRAPVQEYDIEQQTTLCSSLSLTVDQESQLKSGSPGSPSRGGMDEHDSESDSPPGEGGTLEVVLDCVSTPEEELFSSCGFKDGNDFSASARNAADTLEPSS | 113 |
| 564 | MLLPISCRHNKLAFTSSASG | 20 |
| 555 | MGKVPCHMLAHVRGPASRMDPFFT | 24 |
| 565 | MKGSPGSAGIILAESHDLKSDSTEQTQSQMIRSQSSLQGLG | 41 |
| 567 | MSLFIHCTAPSPGPTCRRSMAAHITPTTRAPGDSMAGNRLTMSSAVGSSPPMILKATKAPETPAPYPARMSSKTLPRPIPPMAAPAKPLTTNAEELWGPAKWVATHPPSMLKNIVWLVVRGLVTEAVNAIRDATGLPGRVERPARYWIPLTKFHICLCQKASSFCQLVATMGSMTACCWVARCSNPRTFSLNWWAIA | 198 |
| 568 | MYGAACEHSSISSYC | 15 |
| 569 | MHAMTYFVMGCDKQISFWTGPNRYKRGVGPCSVGLSRTRHFHVSSQLGGGACAPAHTVAW | 60 |
| 570 | MEKVGSRLKSTYCSTATLQSMTESKSPVYPVMRASVAQTTTSPVVGMTDTSRPL | 54 |
| 571 | MLECGTVMLPGGVRVAKTVSLTPAVSA | 27 |
| 572 | MKEPKPSVAATDGFSTRTVYPCAT | 24 |
| 573 | MNCRAFATPLVHTAALKIPATCPEGHITGPPEEPLRQARGLGLSKLAVESPLRRAGMTSASRVTKYKSAEPQAHGSRDLAPGGAGHPTRS | 90 |
| 574 | MTLISMGLNITGSVATARSLRPAAAQCCIGARW SYR | 37 |
| 575 | MLSMIIWKYFPPITERTSMQRRTSTCARTK | 30 |
| 576 | MTPSLLPRASKGGTHTWRADSHLHMVYWFHHIRRPIQCLYQGDKVKKPKRAKTPAPRVALSSPDHAYARWGSMRTSKARGQRPVRL | 86 |
| 577 | MRMTNSHFSAHPTMPDPTP | 19 |
| 578 | MFWWRCIRPVDSAGMGVKEQGSMASSVVECNSGCGSLRSRSSISQRSPLVQLQAAVNRCSNPPTNILTLNNVKLTVHG | 78 |
| 579 | MQRGVNQGPAPHRLYVASGCFLKQSVGQKRSDSFPEFPPPP | 41 |
| 580 | MSQGEAPHVLTNPVEFIHVHPNHRPPGGRRDSSRNTSVSFAPQV | 44 |
| 581 | MLASVKGPHPCLKKVMGLQLLSL | 23 |
| 582 | MNPVFMDSLQFRAVLLMCHEPLVLTSCSFCWAPTLKRLVSPLVA | 44 |
| 583 | MMIATLAQLPCME | 13 |
| 584 | MPQWAPAIMSNKVWGTRRTCATAIPRAGNQFIIISQATRCPERWPGYSEQLQVWTVWWRRGLNVKACPTRKTAPHISPT | 79 |

TABLE 2j-continued

(Seq. ID Nos. 518-587)

HCV 3a ncOrf's 4-6

| SEQ ID No. | Sequence | AA |
|---|---|---|
| 585 | MTSSASYTILLLEQSLVRT | 19 |
| 586 | MYPMRSANPHVRVSMTLPKLRDLRRGSFGPQDGREPRGDRSHPA HPQPSLP | 51 |
| 587 | MVFLLVFLCGLGSVLMLHGLRDLPGHSQAPYQAVPQGLSRPNTT RLVISRGHAQISGY | 58 |

TABLE 2k

(Seq. ID Nos. 588-640)

HCV 3b ncOrf's 1-3
Genbank Accession No.: D49374, D26556

| SEQ ID No. | Sequence | AA |
|---|---|---|
| 588 | MALVRVSCSLQAPPFRESHSGLRNR | 25 |
| 589 | MSCRVGAHNWVGAKQVRLPSDHNLADGVSLPPRHARARAGPGPS PGTLGPSTGMRAVVGQDGSCPPAVLAPAGAKMTPGVDPATWVRS SIP | 91 |
| 590 | MRLAYICLPTTAPTGALCMRPTT | 23 |
| 591 | MSQDIVWLGI | 10 |
| 592 | MGHGTLTALP | 10 |
| 593 | MVPVRTDHIAGTIHPDPVT | 19 |
| 594 | MSVGPSTALHPHRWWWAPLILKACQLIGLV | 30 |
| 595 | MMPRLPAAGPGPGLRQGVW | 19 |
| 596 | MNIDSQPPATGRGESAVILKIVTAVSNNHCSIQRLTR | 37 |
| 597 | MPPSGPGCSCSSGSLPYHHGISTGLAVLSGGTSMPYAGVRPPCK YGSPPCLFEVVGTV | 58 |
| 598 | MTTCPPYRTGLPRVSKDWRWPRSPSSLVLWRLRLSPGVQTQQPA ETSCAGCPFRRGWAASCCWVRLTITRRWDGAYCPRSQHTPSKLG DYLELLSPA | 97 |
| 599 | MVLGRGLLLVTNGPRFKCTPMWTRTW | 26 |
| 600 | MLHRDILS | 8 |
| 601 | MGLTPTSVRGHAPSQPVPNSPTPHTASSSPMGVVLEAPNT | 40 |
| 602 | MNVTRKTLPPYWV | 13 |
| 603 | MAKPSHWQ | 8 |
| 604 | MTQVVPGMTYNLLRPQCD | 18 |
| 605 | MTPSCHRQNSRA | 12 |
| 606 | MRCGNVSYA | 9 |
| 607 | MMRWKNVPSLLLTSSKHRLSLSNSRTKSSACCKGRANKKLKFDP | 44 |
| 608 | MGLGSPAP | 8 |
| 609 | MYHQHTMSPRATRQQK | 16 |
| 610 | MTSGTGSVSYLVTLRPGFRPRSCPRCQAYPFSHVKRGTREYGEG MG | 46 |

TABLE 2k-continued

(Seq. ID Nos. 588-640)

HCV 3b ncOrf's 1-3
Genbank Accession No.: D49374, D26556

| SEQ ID No. | Sequence | AA |
|---|---|---|
| 611 | MAPSPSMNTPLGRVHPSPRTITRVPCGA | 28 |
| 612 | MSRCVGWGILITWWGPRTTA | 20 |
| 613 | MLLLVSPF | 8 |
| 614 | MQMGPSPHANPSRTSQC | 17 |
| 615 | MGRMCPRHSLPWQRDLSRRRNRKGQAHPPQE | 31 |
| 616 | MLTLGPPSVTPKSRAWFAVLCHTPGLAP | 28 |
| 617 | MTITKMYSRR | 10 |
| 618 | MFVPCPAKP | 9 |
| 619 | MTSGRRRGYTNVVTLNQRLGRQSALSQSTGTSGVPCITAKDSNA VIAAAALAASCLPALATQ | 62 |
| 620 | MNHSPVRNFCLHAESV | 16 |
| 621 | MTGSFLGTTRSMPGNLGVPPRDH | 23 |
| 622 | MALAPPRFSPQLGPK | 15 |
| 623 | MRALRRNRQQQHIVLDTDFTDGGRQAPWCDHRVDPKSCEYVGGP ANAVLSTIRRRRLRGRVPCGTSVHL | 69 |
| 624 | MCVDEQYRVCKDLWGSPLQHLWGDEGH | 27 |
| 625 | MPYRLFQEAP | 10 |
| 626 | MLIYTYAPPVNRAHTPPPEHRGRAIPLWCWFCRSGLGSQVGVRR PRLPPSGGRTRVCGPLDDVTDFSGGSSNGELGDAERPQRSGTTG LRLVPGCILRRMAHPGEARSADNLWFDRPVAPSPARPPAPSACL RLDGRRRCHHRGRGAPAPRVLYLITMV | 159 |
| 627 | MGPPPACSR | 9 |
| 628 | MAPTVPDLSIRPANSGTIWNYCHQPDR | 27 |
| 629 | MSPARRYLHTGYRHGAGSSRDSRGEADGTGNRDPSRQHHGAAS | 43 |
| 630 | MSHTPEADSARPYSSPV | 17 |
| 631 | MFPVCSLHRASTGYRSAIQGQSPRLAAKGEPTRS | 34 |
| 632 | MAESGGVLATAHVELCERDPVPGRSLHTARQPCRGFPYGLRRLC NQPPHNQPDYVL | 56 |
| 633 | MCCSVAPACRPWGRSSAVDEQTHSVRISGEPCITNTLCPRERRG SKSNSIAELSNRHPIASPVTPVDQRGLS | 72 |
| 634 | MSKGVQGSMARGWGDDNALPLWGRLYRTRKEWVHEDSRIRPLR | 43 |
| 635 | MPGASARVLHRVRRSEAPPLCSSL | 24 |
| 636 | MRTRAGRRSVNLDVARSCSHHRRHSGPAPCARFTSIGS | 38 |
| 637 | MEGPNLRAARSSRVCLATNSSRTSASPPQKEDNQARWVECVRGT PCPGREIFPVDETGRDRHILLRSRYRIHR | 73 |
| 638 | MQRRGKTTYQSTQQLVAETPQSCLLYVISKRRRTSEEGYLRQT ASAR | 48 |
| 639 | MLSCPPPLRPVEVRV | 15 |
| 640 | MRLSPLPR | 8 |
| | HCV polyprotein | 15 |

TABLE 21

(Seq. ID Nos. 641-712)

HCV 3b ncOrf's 4-6

| SEQ ID No. | Sequence | AA |
|---|---|---|
| 641 | MGSGTRHAVINVVPADTDRKPTRKI | 26 |
| 642 | MESFNDSW | 8 |
| 643 | MFGDSRVKATSVV | 13 |
| 644 | MLHSLFGRVLEPVGRPHRCN | 20 |
| 645 | MVIEHLQSVEGNLLLTCGGASR | 22 |
| 646 | MRPVRLTSGFQ | 11 |
| 647 | MQSYTEGDLVPQKGLTRRSIAVEPHSV | 27 |
| 648 | MSIPHPTHLDITVGGHAPQGTRVIVRGDGCTRPSGVFIDGEGAMPHVSAEA | 51 |
| 649 | MVPPRCERYESVHPLHCSFPRAYMPAQHCSTYHANNQRSRG | 41 |
| 650 | MPHDDDTTY | 9 |
| 651 | MSQSGKHSLPEV | 12 |
| 652 | MAEYKVSSSLDHCQWEGFAIKGDFSVTGEAHLLDIRMRHRDAAGRGRGCQYRQPHPGCLCLIQHRAYTQYGGSVLRVTFIADDHVIGASRTTPIGEELAVCGVGEFGTGCDGACPRTDVGVNPIGF | 126 |
| 653 | MVNSPHDPPYCRTQEGLGGRGQHLHLTSHHVLIPTCQAGDNSSK | 44 |
| 654 | MEQWLLLTAVTIEKITALSPRPVAGG | 26 |
| 655 | MFMSSYEHSDLEYREVHSARIMPQSVRVVYQTPWRKPGPGPAAGKRGIMVLPETIGRAFKVGLICFNVLHPPIDVARGSPTSLYKPCTVHPHTSKPPALGGSQRGQQEDI | 110 |
| 656 | MISDRRGGHTRVLDGHRR | 18 |
| 657 | MSEGSCDAPYRGADERNVPHEVGKSAR | 27 |
| 658 | MPRRRLRSKMKSAPSRRWAVGRLQGEQNIWSWPP | 34 |
| 659 | MKTLRGSSSTSTS | 13 |
| 660 | MLPRKRAGDPSPQMLAPSPP | 20 |
| 661 | MVLLWRQSRSMT | 12 |
| 662 | MTPRPILRQFRASHRTQRWILYLLLRRMCLSLPVSSTGKISLPGQGVPRTHSTHRA | 56 |
| 663 | MKGAKEGCSPVWPR | 14 |
| 664 | MEVNRAQGAGPLWRR | 15 |
| 665 | MKAGTHLHMNAILH | 14 |
| 666 | MGFLGRRSWPPPRNEYPPPYAPRHNCRRSRATGHASNCARGRVYSAQWCIH | 51 |
| 667 | MRERVCLAPWA | 11 |
| 668 | MLLLLLPRRSRGHSVLVIHGSPEMRTL | 27 |
| 669 | MLQVPLGVWLPNLQGG | 16 |
| 670 | MVGSPLHERRQWLDMPPSMQSLGPAVLPVTRSGHLYESVR | 40 |
| 671 | MLSVALWSQQVVGHTRNNLRHSTHIAPPSQTCRTAAPLE | 39 |
| 672 | MDLALGQNIPVQHKRRGLWCFCRFQWGREGILLGRTPGRQGGWNCH | 46 |
| 673 | MLRSGTVGAIPSSCNRQPDPATTRGPTAPKRATRTRCLRRLLCLHPR | 47 |
| 674 | MRRRMQPGTRRNPVVPLR | 18 |
| 675 | MSMAILASQSLNGAVVVAHCGHDLQDHSALPSSSCRRLRIDVHVLLRTF | 49 |
| 676 | MVCPHWDHLC | 10 |
| 677 | MCCCCRFRRRARIRVSARSRRRPHTQCSCWSSRW | 34 |
| 678 | MALPEGGGLEAARHSY | 16 |
| 679 | MPTPTVSRSRQSSKWRVRARDTL | 23 |
| 680 | MSFPPTPTVNQLERSSWPAVGNGVSLVLVRTAQLKRYRPHILAFPPWAMSLARTARARCLHARRGGIPSELRAPATLLSSVGE | 83 |
| 681 | MIAGKSSGVTE | 11 |
| 682 | MEKKWVINTMRTQMVGANMMIFPNQELTGVWRAVSQAARAKGVSGSRVR | 49 |
| 683 | MASVKARRAVLSSSTPQLSDITTKSSPQTRKDGFLRPAALLAAVALM | 47 |
| 684 | MGPPMYSRSVRALIAFRASGSRSQHWYIPSSVLMSCSVTVESKQRVSYENPKGVPFDVHILRRCSTRCLGEYWNP | 75 |
| 685 | MRRAGLRPPFAGFTLNTSFFAIMVVGIGVLLSSNKSSQTERIWFMALLDKERTSFALYPYFDRPEWGGTREHASSKESRRPFTPDARSFTSLSTEL | 96 |
| 686 | MAPVQEYDIEQQTTLCSSESLTVDQSSASRSGSPGSPSRGGMDEYDSTSDSSPVSGESPDSAVDSVPTPEEDVPVPSGFVDGKDLSARARSAADTFDPSSLIVLFLRGGGTGAGRVGGKAHP | 122 |
| 687 | MGKVPCHMLAQRPDPAILMDPPLTCPVKSSPQGQRVVITPSPRHTPLYPF | 50 |
| 688 | MPGTLGMILAESQVLKSLSTIQTQSQMSCNQSPLQGLG | 38 |
| 689 | MSLFIHCTAPSPGPTCRRNTAAHITPTTNAPGDKMAGRRLTMSSVVGSSPPMILKATPAPETPAPYPASTSSNTLPMPMPPTAAPAKPLTTNAEDAAGPARCVATQPPRMLKNIVWLVVRGLVTEAVKAIREATAGLPGSVERPARYWIPLTKFHMCCCQNASAF CHCDCTMGRISASCWLALCSKPRTLSLNC | 195 |
| 690 | MTTQPTDKQ | 9 |
| 691 | MQAMMYLVIGCVMQMSF | 17 |
| 692 | MRHFHISSQHGGLAFARAQTVA | 22 |
| 693 | MPDGRSPGVTNRYIPGLPRPVRPLR | 25 |
| 694 | MEKVGSRLKSTYCSTATLQSITVSKSPVYPVMRASVAHTTTSPDTGIITDTSRPL | 54 |
| 695 | MLPGGVAVASTVSLTPAVSA | 20 |
| 696 | MVRVPVRMLGSIP | 13 |
| 697 | MYVPKPRVAATDGFSTRTEYPCAT | 24 |
| 698 | MNCRAFATPLVHTAALKIPTTCPEGHMTGPPEEPLRQDSGLVLSKLAVESPLRRAGRTSASRVTRYRSEEPHVQGSRDLVPAGAGQPTRSWSTLVYI | 97 |
| 699 | MTPPTVVPKKVWVAVDSTCTSPVTTFLSLPVRLVTIVPNSPRVCWAYAEIGDSRRHPIFL | 60 |

TABLE 21-continued

(Seq. ID Nos. 641-712)

HCV 3b ncOrf's 4-6

| SEQ ID No. | Sequence | AA |
|---|---|---|
| 700 | MSPQAAVSAPQVITLISTGLKMTGSVATASPLRPSAAQSGMGDRWSYR | 48 |
| 701 | MQIRINTWARTK | 12 |
| 702 | MSKIREGYSRLASKITLSRLPRTSRGGTHTCKAASPLHMAYWFHQIRRPTQCLYHGDKVKNPRSRSTPAPMVASSSPVQA | 80 |
| 703 | MCHAAQNATRYQT | 13 |
| 704 | MFWWRCMSPVDRRRIGVNEHGNTSESVVEWSSGCCSLRSRSSRSQRSPLVQLQAAENRCSCPPTNILTLNIEKFTVQG | 78 |
| 705 | MLQGGAPQVETNPVLFIHTHPNHRPWGGLKEVNKKTSDSFTPNL | 44 |
| 706 | MLASVNGPHP | 10 |
| 707 | MGLQLDIRSGHPEELNL | 17 |
| 708 | MCHDPFELTNCKF | 13 |
| 709 | MISTMTTLAQLPCMEK | 16 |
| 710 | MLLLEQSLVSKYRPDAFLYSRLDAGQVKQEKRARRKIEKEQPGRFPVA | 48 |
| 711 | MSGMYPMRSANPHVRVSMTLPKLRDLRRGSFWPQLGREPRGGKSHPAQPQPSFP | 54 |
| 712 | MLHGLRDLPGHSQAPYQAVPQGLSRPNTTRLVISRGHAQISGH | 43 |

TABLE 2m

(Seq. ID Nos. 713-752)

HCV H77 ncOrf's 1-3
Genbank Accession No.: AF011751

| SEQ ID No. | Sequence | AA |
|---|---|---|
| 713 | MGATLHHESLPCEELLSSRRKRLAMALV | 28 |
| 714 | MAMRVAGGRDGSCLPVALGLAGAPQTPGVGRAIWVRSSIPLRAASPTSWGTYRSSAPLLEALPGPWRMASGFWKTA | 76 |
| 715 | MQQGTFLVALSLSSFWPCSLA | 21 |
| 716 | MSPMIALTRVLCTRRPMPSCTLRGVSLAFARVTPRGVGWR | 40 |
| 717 | MPAAPRLGLLVSLHQAPSRTSN | 22 |
| 718 | MKALTPAG | 8 |
| 719 | MPTEAASTNAPTAGTTLQDLVALCPQRACVARYIASLPAPWWWERPTGRARLPTAGVQMIRMSSSLTTPGHRWAIGSVVPG | 81 |
| 720 | MQHPWPGRTVLCPSSCSSALRGI | 23 |
| 721 | MPSSYSCV | 8 |
| 722 | MCITISPLFETGRTTACEIWPLWNQSSSPEWRPSSSRGGQIPPRAVTSSTACPSLPVGARRYCLGQPTEWSPRGGGCWRPSRRTPSREAS | 91 |
| 723 | MGYAGLSTTGPERGPSHHPRVLSSRCIPMWTKTLWAGPLLKVPAH | 45 |
| 724 | MSFPCAGEVIAGVACFRPGPFPT | 23 |
| 725 | MLPPAAVRAPRSRLRTQPRATRCWCSTPLLLQRWALVLTCPRPMGLILISGPG | 53 |

TABLE 2m-continued

(Seq. ID Nos. 713-752)

HCV H77 ncOrf's 1-3
Genbank Accession No.: AF011751

| SEQ ID No. | Sequence | AA |
|---|---|---|
| 726 | MPHPSWASALSLTKQRLRGRDWLCSPLLPLRAPSLCPILTSRRLLCPPPERSPFTARLSPSR | 62 |
| 727 | MPWPTTAVLTCLSSRPAAMLSSCRPMLS | 28 |
| 728 | MLSPGLNAGAGLAGGSQASIDLWHRGSAPPACSTRPSSVSAMTRAVLGMSSRPPRLQLGYERT | 63 |
| 729 | MPTFYPRQSRVGRTFLTW | 18 |
| 730 | MGQHPCYTDWALFRMKSP | 18 |
| 731 | MRWKSALSTYRTSSKG | 16 |
| 732 | MQRLSPLLSRPTGRNSRSFGRSTCGISSVGYNTWRACQRCLVTPPLLH | 48 |
| 733 | MARAWRELL | 9 |
| 734 | MFPPRTTCRRAMQPPASLPYSAASL | 25 |
| 735 | MTPLTPSS | 8 |
| 736 | MSGRSPYLQKECGSLGDSPGPCPSGRGRTTTPR | 33 |
| 737 | MAARYHLHGPLLCLRLGKSVRWSSPNQPYLLPWPSLPPKVLAAPQLPALRATIRQHPLSPPLLAAPPTPTLSPTLPCPPWRGSLGIRISATGHGRRSVVGPTRKMSCAAQCLIPGQAHSSPRALRKNKNCPSTH | 134 |
| 738 | MGQKTSVAMPERP | 13 |
| 739 | MIPAVLTPQSLRATSVRRRQFTNVVTWTPKPAWPSSPSLRGEMLGALLPIQGGKTAATAGAARAAY | 66 |
| 740 | MASAHFHSTVTLQVKSIGWPHASENLGSRPCELGDTGPGASALGFCPEEAGLPYVASTSSTGQ | 63 |
| 741 | MPGPAGSGFAYSCSLQG | 17 |
| 742 | MNHSPVRNYCLHAESV | 16 |
| 743 | MPGDLGVPPQDC | 12 |
| 744 | MAPVSPWLSA | 10 |
| 745 | MGYDDELVPYGSVGGSSAAPDPTSHHGHDRWCSLGSPGGHSVFLHGGELGEGPGSAAAICRRRRGNPRHRGKCRPHHGWACWSPYTRRQAEHPTDQHQRQLAHQ | 104 |
| 746 | MLDCLPRGRNEDHRITQGSCHPDVYQCGPRPCGLARSSRFPLIDTLYLRLLGPLPGHEARRCHSRAPAR | 69 |
| 747 | MHVGRPGGRHEHLGARWRRPGCSGRVLPVNRLRGHSGQDRLVREAGNYT | 49 |
| 748 | MDEPANSLRLPGEPCFPHALRAGERCSRPRHCHTQQPHCNPAPEATASVDKLGVYHSMLRFLAKGHLGLDMRGAERL | 77 |
| 749 | MPVPDPIARIFHRIGRGAPTQVCAPLQALAAGGGIIQSRTPRVPGGVAITLRARTGRSRVDVHAH | 65 |
| 750 | MLLQRVSRPRRRWKEGLLPYP | 21 |
| 751 | MPQKTWGPALASLETPGPERPR | 22 |
| 752 | MWQVPLQLGSKNKAQTHSNSGRWPAGLVRLVHGWLQRGRHLSQRVSCPAPLVLVLPTPARCRGRHLPPPQPMKVGVNTPAS | 81 |

TABLE 2n
(Seq. ID Nos. 753-822)

HCV H77 ncOrf's 4-6

| SEQ ID No. | Sequence | AA |
|---|---|---|
| 753 | MICREASISTLCSHAAHGPFTASRD | 25 |
| 754 | MIPPPAARACKGAQTCVGAPRPIL | 24 |
| 755 | MEWYTPSLSTDAVASGAGLQ | 20 |
| 756 | MLQELPPRPRHTLQECPRGPSPVQRCWRRQLGQHPQRQ | 39 |
| 757 | MKQWRGYQAALTGPPSIVSH | 20 |
| 758 | MRPASRRARRTSSLSGRR | 18 |
| 759 | MWHPWSGTRHKLLCHKHLLSTRRRQGTCRRWST | 33 |
| 760 | MSGNLEERASPQGLGPHWYTSG | 22 |
| 761 | MRWSSFRPRGRQSSIPH | 17 |
| 762 | MATESAPLTRQEQRRTTRPPPCPVRMPAEATPAGAGGEATSRRGRRPLRAPTYPSDTTQSRRTRGRTQDRASRPGMLH | 79 |
| 763 | MWLPDVCGSNQWGRARCCCPPLR | 23 |
| 764 | MPCDDPLYGRDR | 12 |
| 765 | MALPGGGVLEAARHSY | 16 |
| 766 | MPTPAASRSRQNQNQRGRA | 19 |
| 767 | MAALPPLDRSLARTLRARCLQARKGGTPSFLRHAATLLISPGE | 43 |
| 768 | MIGGRSSGSME | 11 |
| 769 | MRTLKKWVISIILAHSVGANMIMLPSQELTGVCLAVSHAALA R GVVGSRVR | 52 |
| 770 | MVQSWSPAARQAARALM | 17 |
| 771 | MATRAWGSRSQHW | 13 |
| 772 | MSLSVTVESKQRVSYENPIGVFLDFHACTRNSTRCPGEYWNP | 42 |
| 773 | MRRAGLRPPFSC3 | 12 |
| 774 | MMVVSIGVTLSSRRSFHTELMWATAFLAWQRTSFAP | 36 |
| 775 | MGSFCSSAAHGVTSAPVQE | 19 |
| 776 | MPEVEELPKLLVASSAKAVDRVDSVRTTVRFFRGGGTGGDRGGGSGQPWTTGGS | 54 |
| 777 | MLPPISCLHRRLASMSSASGESWLAVQVALRDGADSWLAEELAIEGGDPLANLLPAASAVIWEGSVSMDVNTATSGSGSQGNCDPTGYSWSPTLNDTSSRSKGLQGGANLCRRTPSNSVKNSGDGIWHGHLRLSVVIPDT | 140 |
| 778 | MGNVPLHMFLQVLGPTILIVPFLTCPVISAPQWQRVCIMPSPRQTPLYPRWQDTKGIPGSCGMSLAFSQVLKSLSTSHIQSQMSLSQEPEHGVVHSELIH | 100 |
| 779 | MAVTRAAASLSGT | 13 |
| 780 | MAGSRLTRSSVEGTSPLMILNATRAPATPAPYPARMSTRTFPSPTLPMAAPARPAPTKAVAAPGAASWAATHPPNMLKRRVWPVVSGLVTAAVKAINEAMAGLPGSVDRPAKYCIPLMKFHMCFAQKTSSFCQLVWTAGVITSAWRDAVCRRPRAFCLNCSASIIPCSMYGKC | 173 |
| 781 | MTTQPVDRQYAARAARTPPTSTQVLVTTSRSADMHVMMYLVIGCVRVTSF | 50 |
| 782 | MYARSLTVVSAGVSSYQAQPAS | 22 |
| 783 | MPEGRSPGATNL | 12 |
| 784 | MPGFPLPVLPRR | 12 |
| 785 | MVKVGSRLKSTV | 12 |
| 786 | MRASVDTTTTSPLVGMTDTSRPR | 23 |
| 787 | MPNATSFAASSSHFTFEWQKMRCLPPLITSRGIALP | 36 |
| 788 | MLGWDTVTEPGGVAVASTTSLAPAVSAWSRTVPMPKMDVASVEWHSSQTIMS | 52 |
| 789 | MGLPVVIVLTPVLILGSTPWALDM | 24 |
| 790 | MVVPRFSTGIKSTALATPRVHTAALNRPTACPAGHNSGPPEEPFK | 45 |
| 791 | MGRGESRLPLLSPRRRTGMTSACLVTR | 27 |
| 792 | MTGPLGDAMVLVPAPW | 16 |
| 793 | MHVARKVWVAVDTTWTSPSTWFLSRPVRLVIIHPRRPLVCWAYAVMGASNLHPLETIPSAGPSSISWPLRAETGKPLMMSPHAAVSAPHVMSLVSIREKTTGSTATARSRRPLCAQSRRGVRWLYT | 126 |
| 794 | MARSSLVMSNTRVGCTTHMSKMTASRPPRTLRGGTHTCSCASTLVRKY | 48 |
| 795 | MSNIIHKQEQTRASASRRNRRTTYSHLMAQDAMLDPTPYKYCTSTMFWWRWMRPVDKAGRVVKEHGRTCHCVVDSSNGLSSDLSLSSRSQRSPRVQLQAASSLCSTPPTYILTLNMV | 117 |
| 796 | MHLGVIQGPEPHREYVASGCLRKQSVGQSKVLLPTPPMTQGGAPHTLVNPVEFIQVQPNQLPSGGLVLLRTKTSVSFAPQL | 81 |
| 797 | MCQLPLVLISWMFCLAPGVRRPTSPAVVRPAFPPVTWVSASTPANSSSTTRTFAQFPTMEKYAMPARTPQ | 70 |
| 798 | MSMMACGIRSS | 11 |
| 799 | MASAASYTILELGQSLVTW | 19 |
| 800 | MYPMRSAKPHVRVSMTLPKLRDLRRGSVGPQLGREPRGDRSHPAHPQPSLP | 51 |
| 801 | MVHGLRDLPGHSQAPYQAVPQGLSRPNTTRLAVLRGHAQISRH | 43 |
| 802 | MRLTDLSQLAVTRAKMEPPLKKGKRKEKKKERKEKKKEKKKKKKKKNRKWLKRPECLPQPSSVGEEVDAYPCSEQE | 76 |
| 803 | MRHAVINVSPAVASREPTGQVQPASGRYWSEFELCSYCPVEEVLATYGSPASSGQKPSADAPGPVSPSSQGRDPKFSEACGHPTDFTWRVTVE | 93 |
| 804 | MESLNDWR | 8 |
| 805 | MGHQYHPRPQCGGKHDYVA | 19 |
| 806 | MATDVFCPIAKLGFG | 15 |
| 807 | MWGRQAASFLYG | 12 |
| 808 | MAVQNLQSVKCDFLLPLASTA | 21 |
| 809 | MDHRWFVVRLFPRLY | 15 |
| 810 | MVGGASCLERWSGQLASRGAGHRRG | 25 |
| 811 | MGGISEHGRQHGYVRFGLAR | 20 |

TABLE 2n-continued (Seq. ID Nos. 753-822)

HCV H77 ncOrf's 4-6

| SEQ ID No. | Sequence | AA |
|---|---|---|
| 812 | MSSDLSSTVAASVHNAVSSPDPPIPALAGHKGNPRQLWHELGFQPGLKVAQHLAYPVPDVP | 61 |
| 813 | MQSPQELGYSEAAEYGSDAGGCIALRHVVRGGNMVPPGGEGY | 42 |
| 814 | MAGRGLQEAEGLLLELLSEHHPLLDVR | 27 |
| 815 | MEGGFKADQTLPHLVPRWGRGLSPSAHGGLVRYQVRKVLPTLLCLG | 46 |
| 816 | MSEARKDALPKFKMVLAHGKPRGVHVRS | 28 |
| 817 | MSSPLDHLEGDSLAVKGDLSGGGQSNLLDVRMGHSDGARRGSSGEHNQSRPRSLCLVKDSADAQDGCGIRGVALVTNYYVISTS | 84 |
| 818 | MGLGHVSTKAQRCSNRGVEHQHLVALGCVRSRDLGALTAAGGSMQVGHLEALGHCWWRGVVREHRGSHGCP | 71 |
| 819 | MVIHIGASKRP | 11 |
| 820 | MTSGYLPR | 8 |
| 821 | MFAEAISGAEQGVVAHPSDDTRGRSAHFGESS | 32 |
| 822 | MTRYMAGIDRTIAVLRRPVAPGREGKQLTNKKDRPAQVPHVEGRAEGGAPDKQIDMTSKLRCGEFAVPGGHRGGHRHPTPRGVTLANARDTPRSVQDGIGRLVHNTRVRAIIGDMVKPRGIAHLVG | 126 |

Using Web-based computer software for the prediction of possible CTL epitopes for different HLA-alleles, every single ORF was analyzed for the existence of (possibly) encoded epitopes resulting in a (relative) cut-off value of 10 or more (according to Parker et al, mentioned above).

TABLE 3

| Strain | Frames | Number of epitopes No. of epitopes** | Epitope sequence listed in table 4 |
|---|---|---|---|
| 1a | 1-3 | 232 | Table 4a |
|  | 4-6 | 511 | Table 4b |
| 1b | 1-3 | 238 | Table 4c |
|  | 4-6 | 512 | Table 4d |
| 2a | 1-3 | 238 | Table 4e |
|  | 4-6 | 626 | Table 4f |
| 2b | 1-3 | 268 | Table 4g |
|  | 4-6 | 561 | Table 4h |
| 3a | 1-3 | 219 | Table 4i |
|  | 4-6 | 528 | Table 4j |
| 3b | 1-3 | 231 | Table 4k |
|  | 4-6 | 507 | Table 4l |
| H77 | 1-3 | 293 | Table 4m |
|  | 4-6 | 711 | Table 4n |

(**for eight different HLA-alleles)

In the following table 4, the exact (minimum) sequence of the eptiopes found with respect to the HLA alleles tested are given together with a (relative) score identifying the ability of the given epitope to be efficient in binding the given HLA type.

TABLE 4a 1a (1-3)

| No. | Strain | ORF | Start | AA | HLA | Peptide sequence | Seq ID NO. | Score |
|---|---|---|---|---|---|---|---|---|
| 1 | HCV-1a | 1 | 14 | 10 | B8 | ELLSSRRKRL | 2922 | 16.000 |
| 2 | HCV-1a | 1 | 17 | 9 | B8 | SSRRKRLAM | 2923 | 20.000 |
| 3 | HCV-1a | 1 | 16 | 10 | B3501 | LSSRRKRLAM | 2924 | 10.000 |
| 4 | HCV-1a | 1 | 17 | 9 | B3501 | SSRRKRLAM | 2925 | 30.000 |
| 5 | HCV-1a | 1 | 17 | 9 | B7 | SSRRKRLAM | 2926 | 15.000 |
| 6 | HCV-1a | 1 | 2 | 9 | B7 | GATLHHESL | 2927 | 12.000 |
| 7 | HCV-1a | 1 | 15 | 9 | A0201 | LLSSRRKRL | 2928 | 36.316 |
| 8 | HCV-1a | 2 | 43 | 10 | B4403 | AASPTSWGTY | 2929 | 12.000 |
| 9 | HCV-1a | 2 | 53 | 10 | B3501 | RSSAPLLEAL | 2930 | 10.000 |
| 10 | HCV-1a | 2 | 64 | 10 | B3501 | GPWRMASGFW | 2931 | 10.000 |
| 11 | HCV-1a | 2 | 64 | 9 | B3501 | GPWRMASGF | 2932 | 20.000 |
| 12 | HCV-1a | 2 | 44 | 9 | B3501 | ASPTSWGTY | 2933 | 10.000 |
| 13 | HCV-1a | 2 | 26 | 9 | B3501 | TPGVGRAIW | 2934 | 10.000 |
| 14 | HCV-1a | 2 | 5 | 10 | B7 | AAGGRDGSCL | 2935 | 36.000 |
| 15 | HCV-1a | 2 | 32 | 10 | B7 | AIWVRSSIPL | 2936 | 12.000 |
| 16 | HCV-1a | 2 | 6 | 9 | B7 | AGGRDGSCL | 2937 | 12.000 |
| 17 | HCV-1a | 2 | 51 | 9 | A24 | TYRSSAPLL | 2938 | 200.000 |
| 18 | HCV-1a | 2 | 12 | 9 | A24 | SCLPVALGL | 2939 | 10.080 |
| 19 | HCV-1a | 2 | 32 | 10 | A0201 | AIWVRSSIPL | 2940 | 24.380 |
| 20 | HCV-1a | 2 | 67 | 10 | A0201 | RMASGFWKTA | 2941 | 23.178 |
| 21 | HCV-1a | 2 | 67 | 9 | A0201 | RMASGFWKT | 2942 | 76.694 |
| 22 | HCV-1a | 2 | 58 | 10 | A1 | LLEALPGPWR | 2943 | 18.000 |
| 23 | HCV-1a | 3 | 9 | 10 | A0201 | ALSLSSFWPC | 2944 | 70.794 |
| 24 | HCV-1a | 3 | 1 | 10 | A0201 | MQQGTFLVAL | 2945 | 32.181 |
| 25 | HCV-1a | 3 | 11 | 10 | A0201 | SLSSFWPCSL | 2946 | 21.362 |
| 26 | HCV-1a | 3 | 2 | 9 | A0201 | QQGTFLVAL | 2947 | 18.930 |
| 27 | HCV-1a | 4 | 16 | 9 | B8 | SCTLRGASL | 2948 | 16.000 |
| 28 | HCV-1a | 5 | 7 | 10 | B3501 | RSFDVTSICL | 2949 | 20.000 |
| 29 | HCV-1a | 5 | 19 | 10 | B3501 | APPSVRFSTW | 2950 | 10.000 |
| 30 | HCV-1a | 5 | 49 | 10 | B7 | TGRRKVAIAL | 2951 | 40.000 |
| 31 | HCV-1a | 5 | 4 | 9 | B7 | SPRRSFDVT | 2952 | 20.000 |
| 32 | HCV-1a | 5 | 8 | 9 | A24 | SFDVTSICL | 2953 | 20.000 |
| 33 | HCV-1a | 5 | 36 | 10 | A0201 | FLSANCLPSL | 2954 | 226.014 |
| 34 | HCV-1a | 5 | 33 | 10 | A0201 | GLSFLSANCL | 2955 | 21.362 |

TABLE 4a-continued 1a (1-3)

| No. | Strain | ORF | Start | AA | HLA | Peptide sequence | Seq ID NO. | Score |
|---|---|---|---|---|---|---|---|---|
| 35 | HCV-1a | 5 | 15 | 9 | A0201 | CLSGAPPSV | 2956 | 69.552 |
| 36 | HCV-1a | 6 | 11 | 10 | A24 | GFSITTSSTL | 2957 | 20.000 |
| 37 | HCV-1a | 7 | 24 | 10 | B3501 | CPRRVCVVRY | 2958 | 120.000 |
| 38 | HCV-1a | 7 | 51 | 10 | B3501 | RPPTAGVKMI | 2959 | 16.000 |
| 39 | HCV-1a | 7 | 51 | 9 | B3501 | RPPTAGVKM | 2960 | 80.000 |
| 40 | HCV-1a | 7 | 29 | 9 | B7 | CVVRYIASL | 2961 | 20.000 |
| 41 | HCV-1a | 7 | 51 | 9 | B7 | RPPTAGVKM | 2962 | 20.000 |
| 42 | HCV-1a | 7 | 12 | 9 | B7 | TAGTTPQNL | 2963 | 12.000 |
| 43 | HCV-1a | 7 | 36 | 10 | A3 | SLPAPWWWER | 2964 | 36.000 |
| 44 | HCV-1a | 7 | 32 | 10 | A24 | RYIASLPAPW | 2965 | 18.000 |
| 45 | HCV-1a | 7 | 58 | 9 | A24 | KMIRTSSSL | 2966 | 12.000 |
| 46 | HCV-1a | 7 | 22 | 10 | A0201 | VLCPRRVCVV | 2967 | 111.499 |
| 47 | HCV-1a | 7 | 21 | 10 | A0201 | AVCLPRRVCV | 2968 | 22.517 |
| 48 | HCV-1a | 7 | 58 | 10 | A0201 | KMIRTSSSLT | 2969 | 18.837 |
| 49 | HCV-1a | 7 | 19 | 10 | A0201 | NLAVLCPRRV | 2970 | 13.910 |
| 50 | HCV-1a | 7 | 22 | 9 | A0201 | VLCPRRVCV | 2971 | 118.238 |
| 51 | HCV-1a | 7 | 58 | 9 | A0201 | KMIRTSSSL | 2972 | 53.999 |
| 52 | HCV-1a | 7 | 67 | 9 | A0201 | TIPGHRWAI | 2973 | 10.759 |
| 53 | HCV-1a | 8 | 10 | 10 | A0201 | VLPSSCSSA | 2974 | 27.026 |
| 54 | HCV-1a | 8 | 11 | 10 | A24 | LYPSSCSSAL | 2975 | 300.000 |
| 55 | HCV-1a | 8 | 3 | 9 | B7 | HPWPGRTVL | 2976 | 120.000 |
| 56 | HCV-1a | 8 | 12 | 9 | B7 | YPSSCSSAL | 2977 | 80.000 |
| 57 | HCV-1a | 9 | 15 | 9 | B7 | TACEIWPWL | 2978 | 12.000 |
| 58 | HCV-1a | 9 | 1 | 9 | A24 | MFITISLLF | 2979 | 21.000 |
| 59 | HCV-1a | 9 | 15 | 9 | A0201 | TACEIWPWL | 2980 | 11.374 |
| 60 | HCV-1a | 9 | 2 | 10 | A0201 | FITISLLFGT | 2981 | 62.877 |
| 61 | HCV-1a | 9 | 7 | 10 | A0201 | LLFGTGRTTA | 2982 | 31.249 |
| 62 | HCV-1a | 10 | 1 | 10 | B4403 | MEWSPRVGGC | 2983 | 12.000 |
| 63 | HCV-1a | 11 | 13 | 10 | A24 | RGPSRHPRVL | 2984 | 27.000 |
| 64 | HCV-1a | 11 | 5 | 9 | A3 | GLSTTGPER | 2985 | 12.000 |
| 65 | HCV-1a | 11 | 14 | 9 | B7 | GPSRHPRVL | 2986 | 80.000 |
| 66 | HCV-1a | 11 | 18 | 9 | B7 | HPRVLSSCR | 2987 | 20.000 |
| 67 | HCV-1a | 11 | 18 | 10 | B7 | HPRVLSSCRI | 2988 | 80.000 |
| 68 | HCV-1a | 11 | 14 | 9 | B3501 | GPSRHPRVL | 2989 | 20.000 |
| 69 | HCV-1a | 11 | 18 | 10 | B3501 | HPRVLSSRCI | 2990 | 24.000 |
| 70 | HCV-1a | 13 | 9 | 10 | B3501 | APRSRLHMQL | 2991 | 60.000 |
| 71 | HCV-1a | 13 | 8 | 9 | B3501 | KAPRSRLHM | 2992 | 12.000 |
| 72 | HCV-1a | 13 | 9 | 10 | B8 | APRSRLHMQL | 2993 | 16.000 |
| 73 | HCV-1a | 13 | 6 | 9 | B8 | AAKAPRSRL | 2994 | 16.000 |
| 74 | HCV-1a | 13 | 9 | 10 | B7 | APRSRLHMQL | 2995 | 2.400.000 |
| 75 | HCV-1a | 13 | 5 | 10 | B7 | AAAKAPRSRL | 2996 | 81.000 |
| 76 | HCV-1a | 13 | 6 | 9 | B7 | AAKAPRSRL | 2997 | 81.000 |
| 77 | HCV-1a | 15 | 1 | 10 | B3501 | MPHPSWASAL | 2998 | 20.000 |
| 78 | HCV-1a | 15 | 36 | 10 | B3501 | CPIPTSRRLL | 2999 | 20.000 |
| 79 | HCV-1a | 15 | 3 | 10 | B3501 | HPSWASALSL | 3000 | 20.000 |
| 80 | HCV-1a | 15 | 46 | 9 | B3501 | CPPPERSLF | 3001 | 30.000 |
| 81 | HCV-1a | 15 | 36 | 9 | B3501 | CPIPTSRRL | 3002 | 20.000 |
| 82 | HCV-1a | 15 | 36 | 10 | B7 | CPIPTSRRLL | 3003 | 120.000 |
| 83 | HCV-1a | 15 | 1 | 10 | B7 | MPHPSWASAL | 3004 | 80.000 |
| 84 | HCV-1a | 15 | 3 | 10 | B7 | HPSWASALSL | 3005 | 80.000 |
| 85 | HCV-1a | 15 | 14 | 10 | B7 | KQRLRGRDWL | 3006 | 60.000 |
| 86 | HCV-1a | 15 | 8 | 10 | B7 | SALSLTKQRL | 3007 | 12.000 |
| 87 | HCV-1a | 15 | 36 | 9 | B7 | CPIPTSRRL | 3008 | 80.000 |
| 88 | HCV-1a | 15 | 9 | 9 | B7 | ALSLTKQRL | 3009 | 12.000 |
| 89 | HCV-1a | 15 | 22 | 9 | A0201 | WLCSPPPPL | 3010 | 98.267 |
| 90 | HCV-1a | 15 | 9 | 9 | A0201 | ALSLTKQRL | 3011 | 21.362 |
| 91 | HCV-1a | 16 | 11 | 10 | B3501 | CPSSRPAAML | 3012 | 20.000 |
| 92 | HCV-1a | 16 | 11 | 9 | B3501 | CPSSRPAAM | 3013 | 40.000 |
| 93 | HCV-1a | 16 | 11 | 9 | B3501 | MPWPTTAVL | 3014 | 20.000 |
| 94 | HCV-1a | 16 | 11 | 9 | B3501 | RPAAMLSSW | 3015 | 20.000 |
| 95 | HCV-1a | 16 | 11 | 10 | B7 | CPSSRPAAML | 3016 | 120.000 |
| 96 | HCV-1a | 16 | 17 | 10 | B7 | AAMLSSWQPM | 3017 | 27.000 |
| 97 | HCV-1a | 16 | 1 | 9 | B7 | MPWPTTAVL | 3018 | 80.000 |
| 98 | HCV-1a | 16 | 11 | 9 | B7 | CPSSRPAAM | 3019 | 20.000 |
| 99 | HCV-1a | 16 | 18 | 9 | A0201 | AMLSSWQPM | 3020 | 22.569 |
| 100 | HCV-1a | 17 | 52 | 9 | B3501 | RPPRLQLGY | 3021 | 80.000 |
| 101 | HCV-1a | 17 | 50 | 9 | B3501 | SSRPPRLQL | 3022 | 15.000 |
| 102 | HCV-1a | 17 | 3 | 10 | B7 | SPALNVGAGL | 3023 | 80.000 |
| 103 | HCV-1a | 17 | 38 | 10 | B7 | SVSAMTQAVL | 3024 | 20.000 |
| 104 | HCV-1a | 17 | 13 | 10 | B7 | AGGSQASTDL | 3025 | 12.000 |
| 105 | HCV-1a | 17 | 47 | 10 | B7 | LGMSSRPPRL | 3026 | 12.000 |
| 106 | HCV-1a | 17 | 33 | 10 | B7 | STRPSSVSAM | 3027 | 10.000 |
| 107 | HCV-1a | 17 | 50 | 9 | B7 | SSRPPRLQL | 3028 | 90.000 |
| 108 | HCV-1a | 17 | 48 | 9 | A0201 | GMSSRPPRL | 3029 | 15.428 |
| 109 | HCV-1a | 18 | 7 | 10 | A0201 | RQSRVGRTFL | 3030 | 11.913 |

TABLE 4a-continued 1a (1-3)

| No. Strain | ORF | Start | AA | HLA | Peptide sequence | Seq ID NO. | Score |
|---|---|---|---|---|---|---|---|
| 110 HCV-1a | 18 | 8 | 9 | A0201 | QSRVGRTFL | 3031 | 60.000 |
| 111 HCV-1a | 18 | 5 | 10 | B7 | YPRQSRVGRT | 3032 | 20.000 |
| 112 HCV-1a | 18 | 5 | 10 | B8 | YPRQSRVGRT | 3033 | 16.000 |
| 113 HCV-1a | 18 | 8 | 9 | B3501 | QSRVGRTFL | 3034 | 15.000 |
| 114 HCV-1a | 18 | 3 | 10 | B3501 | SPALNVGAGL | 3035 | 20.000 |
| 115 HCV-1a | 19 | 7 | 10 | A1 | YTDWALFRMK | 3036 | 25.000 |
| 116 HCV-1a | 19 | 6 | 10 | A24 | CYTDWALFRM | 3037 | 30.000 |
| 117 HCV-1a | 19 | 4 | 9 | B7 | HPCYTDWAL | 3038 | 80.000 |
| 118 HCV-1a | 19 | 4 | 9 | B3501 | HPCYTDWAL | 3039 | 20.000 |
| 119 HCV-1a | 19 | 4 | 10 | B3501 | HPCYTDWALF | 3040 | 30.000 |
| 120 HCV-1a | 20 | 6 | 10 | A3 | ALSTYRTSSK | 3041 | 20.000 |
| 121 HCV-1a | 21 | 1 | 9 | B7 | MARAWRELL | 3042 | 180.000 |
| 122 HCV-1a | 21 | 1 | 9 | B8 | MARAWRELL | 3043 | 16.000 |
| 123 HCV-1a | 22 | 3 | 10 | B3501 | PPRTTCRRAM | 3044 | 12.000 |
| 124 HCV-1a | 22 | 3 | 10 | B7 | PPRTTCRRAM | 3045 | 30.000 |
| 125 HCV-1a | 22 | 16 | 10 | B7 | ASLPYSAASL | 3046 | 12.000 |
| 126 HCV-1a | 22 | 10 | 9 | B7 | RAMQLPASL | 3047 | 36.000 |
| 127 HCV-1a | 22 | 10 | 9 | A24 | RAMQLPASL | 3048 | 14.400 |
| 128 HCV-1a | 22 | 17 | 9 | A0201 | SLPYSAASL | 3049 | 21.362 |
| 129 HCV-1a | 23 | 19 | 9 | A24 | RYGGCLQRN | 3050 | 12.000 |
| 130 HCV-1a | 23 | 19 | 10 | A24 | RYGGCLQRNT | 3051 | 12.000 |
| 131 HCV-1a | 23 | 3 | 10 | B8 | TPRAPVPPFL | 3052 | 16.000 |
| 132 HCV-1a | 23 | 3 | 9 | B8 | TPRAPVPPF | 3053 | 60.000 |
| 133 HCV-1a | 23 | 3 | 10 | B3501 | TPRAPVPPFL | 3054 | 60.000 |
| 134 HCV-1a | 23 | 15 | 10 | B7 | TTRSRYGGCL | 3055 | 40.000 |
| 135 HCV-1a | 23 | 3 | 10 | B7 | TPRAPVPPFL | 3056 | 800.000 |
| 136 HCV-1a | 25 | 33 | 9 | B3501 | WPSSPPEAL | 3057 | 20.000 |
| 137 HCV-1a | 25 | 72 | 9 | B3501 | SPIPPCPPW | 3058 | 10.000 |
| 138 HCV-1a | 25 | 96 | 10 | B3501 | RSVVRPTRRM | 3059 | 20.000 |
| 139 HCV-1a | 25 | 16 | 10 | B8 | LGRSGRWSSL | 3060 | 16.000 |
| 140 HCV-1a | 25 | 2 | 10 | B8 | AARFHLQSPL | 3061 | 16.000 |
| 141 HCV-1a | 25 | 2 | 10 | B7 | AARFHLQSPL | 3062 | 360.000 |
| 142 HCV-1a | 25 | 16 | 10 | B7 | LGRSGRWSSL | 3063 | 40.000 |
| 143 HCV-1a | 25 | 65 | 10 | B7 | APPTPTLSPI | 3064 | 24.000 |
| 144 HCV-1a | 25 | 123 | 10 | B7 | APRKNRNCPS | 3065 | 12.000 |
| 145 HCV-1a | 25 | 40 | 10 | B7 | ALAAPQLPAL | 3066 | 12.000 |
| 146 HCV-1a | 25 | 75 | 10 | B7 | PPCPPWRGSL | 3067 | 12.000 |
| 147 HCV-1a | 25 | 33 | 9 | B7 | WPSSPPEAL | 3068 | 120.000 |
| 148 HCV-1a | 25 | 63 | 9 | B7 | LAAPPTPTL | 3069 | 18.000 |
| 149 HCV-1a | 25 | 41 | 9 | B7 | LAAPQLPAL | 3070 | 12.000 |
| 150 HCV-1a | 25 | 50 | 9 | B7 | RATIRQHPL | 3071 | 12.000 |
| 151 HCV-1a | 25 | 4 | 9 | A24 | RFHLQSPLL | 3072 | 40.000 |
| 152 HCV-1a | 25 | 54 | 9 | A24 | RQHPLSPPL | 3073 | 11.520 |
| 153 HCV-1a | 25 | 83 | 9 | A24 | SLGIRILAT | 3074 | 17.140 |
| 154 HCV-1a | 25 | 104 | 9 | A24 | RMSCAAQCL | 3075 | 15.428 |
| 155 HCV-1a | 25 | 62 | 9 | A24 | LLAAPPTPT | 3076 | 12.668 |
| 156 HCV-1a | 25 | 45 | 9 | A24 | QLPALRATI | 3077 | 10.433 |
| 157 HCV-1a | 25 | 40 | 10 | A0201 | ALAAPQLPAL | 3078 | 49.134 |
| 158 HCV-1a | 25 | 62 | 10 | A0201 | LLAAPPTPTL | 3079 | 36.316 |
| 159 HCV-1a | 27 | 33 | 10 | B3501 | WPSSPSPRGF | 3080 | 20.000 |
| 160 HCV-1a | 27 | 2 | 10 | B3501 | IPAALTPQSL | 3081 | 20.000 |
| 161 HCV-1a | 27 | 38 | 10 | B3501 | SPRGFMLGAL | 3082 | 60.000 |
| 162 HCV-1a | 27 | 36 | 9 | B3501 | SPSPRGFML | 3083 | 20.000 |
| 163 HCV-1a | 27 | 35 | 9 | B3501 | SSPSPRGFM | 3084 | 10.000 |
| 164 HCV-1a | 27 | 38 | 10 | B8 | SPRGFMLGAL | 3085 | 16.000 |
| 165 HCV-1a | 27 | 36 | 10 | B8 | SPSPRGFML | 3086 | 16.000 |
| 166 HCV-1a | 27 | 38 | 10 | B7 | SPRGFMLGAL | 3087 | 800.000 |
| 167 HCV-1a | 27 | 2 | 10 | B7 | IPAALTPQSL | 3088 | 80.000 |
| 168 HCV-1a | 27 | 15 | 10 | B7 | SVRRQSTNV | 3089 | 10.000 |
| 169 HCV-1a | 27 | 36 | 9 | B7 | SPSPRGFML | 3090 | 80.000 |
| 170 HCV-1a | 27 | 38 | 9 | B7 | SPRGFMLGA | 3091 | 20.000 |
| 171 HCV-1a | 27 | 42 | 9 | A0201 | FMLGALLPI | 3092 | 294.957 |
| 172 HCV-1a | 28 | 48 | 9 | B4403 | EEAGLPYVA | 3093 | 12.000 |
| 173 HCV-1a | 28 | 48 | 10 | B4403 | EEAGLPYVAS | 3094 | 12.000 |
| 174 HCV-1a | 28 | 31 | 10 | B4403 | CELGDTGPGA | 3095 | 12.000 |
| 175 HCV-1a | 28 | 37 | 10 | B3501 | GPGASALGFW | 3096 | 10.000 |
| 176 HCV-1a | 28 | 19 | 10 | B3501 | WPHASENLGY | 3097 | 60.000 |
| 177 HCV-1a | 28 | 3 | 10 | B7 | SAHFHSTVTL | 3098 | 12.000 |
| 178 HCV-1a | 28 | 44 | 9 | A24 | GFWPEEAGL | 3099 | 24.000 |
| 179 HCV-1a | 28 | 25 | 9 | A0201 | NLGYRPCEL | 3100 | 21.362 |
| 180 HCV-1a | 28 | 46 | 9 | A1 | WPEEAGLPY | 3101 | 56.250 |
| 181 HCV-1a | 29 | 3 | 9 | B4403 | GPAGSGFAY | 3102 | 13.500 |
| 182 HCV-1a | 29 | 1 | 9 | B3501 | MPGPAGSGF | 3103 | 20.000 |
| 183 HCV-1a | 29 | 3 | 9 | B3501 | GPAGSGFAY | 3104 | 40.000 |
| 184 HCV-1a | 29 | 5 | 10 | B7 | AGSGFAYSCL | 3105 | 12.000 |

TABLE 4a-continued

1a (1-3)

| No. | Strain | ORF | Start | AA | HLA | Peptide sequence | Seq ID NO. | Score |
|---|---|---|---|---|---|---|---|---|
| 185 | HCV-1a | 33 | 50 | 10 | B4403 | GEGPGSAAAI | 3106 | 12.000 |
| 186 | HCV-1a | 33 | 47 | 10 | B4403 | GELGEGPGSA | 3107 | 12.000 |
| 187 | HCV-1a | 33 | 47 | 9 | B4403 | GELGEGPGS | 3108 | 12.000 |
| 188 | HCV-1a | 33 | 5 | 9 | B4403 | DELVPYDGV | 3109 | 24.000 |
| 189 | HCV-1a | 33 | 36 | 9 | B3501 | SPGGHSVFL | 3110 | 20.000 |
| 190 | HCV-1a | 33 | 17 | 10 | B7 | SAAPDPTSHL | 3111 | 18.000 |
| 191 | HCV-1a | 33 | 36 | 9 | B7 | SPGGHSVFL | 3112 | 80.000 |
| 192 | HCV-1a | 33 | 18 | 9 | B7 | AAPDPTSHL | 3113 | 54.000 |
| 193 | HCV-1a | 33 | 41 | 9 | B7 | SVFLHGGEL | 3114 | 20.000 |
| 194 | HCV-1a | 33 | 33 | 10 | A0201 | SLGSPGGHSV | 3115 | 69.552 |
| 195 | HCV-1a | 34 | 14 | 9 | B8 | GARWRRPGC | 3116 | 16.000 |
| 196 | HCV-1a | 34 | 23 | 10 | B7 | FGRVLPVNRL | 3117 | 60.000 |
| 197 | HCV-1a | 34 | 19 | 9 | B7 | PRGCFGRVL | 3118 | 80.000 |
| 198 | HCV-1a | 34 | 5 | 9 | B7 | RPGGRHEHL | 3119 | 80.000 |
| 199 | HCV-1a | 35 | 5 | 10 | B3501 | LAKGHLGLDM | 3120 | 18.000 |
| 200 | HCV-1a | 35 | 1 | 10 | B7 | MLRFLAKGHL | 3121 | 40.000 |
| 201 | HCV-1a | 35 | 11 | 9 | A3 | GLDMRGVER | 3122 | 12.000 |
| 202 | HCV-1a | 35 | 3 | 10 | A24 | RFLAKGHLGL | 3123 | 60.000 |
| 203 | HCV-1a | 35 | 4 | 9 | A0201 | FLAKGHLGL | 3124 | 98.000 |
| 204 | HCV-1a | 35 | 11 | 9 | A1 | GLDMRGVER | 3125 | 10.000 |
| 205 | HCV-1a | 35 | 19 | 9 | B3501 | RPGCFGRVL | 3126 | 40.000 |
| 206 | HCV-1a | 35 | 5 | 9 | B3501 | RPGGRHEHL | 3127 | 40.000 |
| 207 | HCV-1a | 36 | 15 | 9 | B4403 | GGLPLRDGY | 3128 | 12.000 |
| 208 | HCV-1a | 36 | 17 | 9 | B3501 | LPLRDGYDY | 3129 | 60.000 |
| 209 | HCV-1a | 36 | 4 | 10 | B8 | VCRGIRGDKA | 3130 | 16.000 |
| 210 | HCV-1a | 36 | 16 | 10 | A3 | GLPLRDGYDY | 3131 | 36.000 |
| 211 | HCV-1a | 37 | 3 | 9 | B3501 | VPGPIARIF | 3132 | 20.000 |
| 212 | HCV-1a | 37 | 1 | 10 | B7 | MPVPGPIARI | 3133 | 12.000 |
| 213 | HCV-1a | 39 | 8 | 10 | B3501 | RPRRRWKEGL | 3134 | 120.000 |
| 214 | HCV-1a | 39 | 8 | 10 | B7 | RPRRRWKEGL | 3135 | 800.000 |
| 215 | HCV-1a | 40 | 1 | 10 | B3501 | MPQKTWGTAL | 3136 | 20.000 |
| 216 | HCV-1a | 40 | 1 | 10 | B7 | MPQKTWGTAL | 3137 | 80.000 |
| 217 | HCV-1a | 40 | 4 | 10 | A0201 | KTWGTALASL | 3138 | 19.824 |
| 218 | HCV-1a | 40 | 12 | 9 | A1 | SLETPGPER | 3139 | 18.000 |
| 219 | HCV-1a | 41 | 26 | 10 | A0201 | GLVRLVHGWL | 3140 | 15.274 |
| 220 | HCV-1a | 41 | 22 | 9 | A24 | RWPAGLVRL | 3141 | 12.000 |
| 221 | HCV-1a | 41 | 65 | 9 | A3 | HLPPPQPVK | 3142 | 45.000 |
| 222 | HCV-1a | 41 | 29 | 9 | A3 | RLVHGWLQR | 3143 | 12.000 |
| 223 | HCV-1a | 41 | 27 | 9 | B7 | LVRLVHGWL | 3144 | 200.000 |
| 224 | HCV-1a | 41 | 47 | 9 | B7 | CPAPLDLVL | 3145 | 80.000 |
| 225 | HCV-1a | 41 | 57 | 10 | B7 | TPACCRGRHL | 3146 | 80.000 |
| 226 | HCV-1a | 41 | 42 | 10 | B7 | SQRVSCPAPL | 3147 | 40.000 |
| 227 | HCV-1a | 41 | 44 | 10 | B7 | RVSCPAPLDL | 3148 | 20.000 |
| 228 | HCV-1a | 41 | 57 | 10 | B8 | TPACCRGRHL | 3149 | 16.000 |
| 229 | HCV-1a | 41 | 47 | 9 | B3501 | CPAPLDLVL | 3150 | 20.000 |
| 230 | HCV-1a | 41 | 57 | 10 | B3501 | TPACCRGRHL | 3151 | 20.000 |
| 231 | HCV-1a | 42 | 3 | 9 | B7 | VVQQPPGPPL | 3152 | 30.000 |
| 232 | HCV-1a | 42 | 2 | 10 | B7 | SVVQPPGPPL | 3153 | 30.000 |

TABLE 4b

1a (4-6)

| No. | Strain | ORF | Start | AA | HLA | Peptide sequence | SEQ ID NO | Score |
|---|---|---|---|---|---|---|---|---|
| 1 | HCV-1a | 1 | 15 | 9 | A24 | TYVGAPRPI | 3154 | 75.000 |
| 2 | HCV-1a | 1 | 16 | 9 | B7 | YVGAPRPIL | 3155 | 45.000 |
| 3 | HCV-1a | 1 | 8 | 9 | B_3501 | RACRGAQTY | 3156 | 12.000 |
| 4 | HCV-1a | 1 | 15 | 10 | A24 | TYVGAPRPIL | 3157 | 300.000 |
| 5 | HCV-1a | 1 | 6 | 10 | B8 | AARACRGAQT | 3158 | 16.000 |
| 6 | HCV-1a | 2 | 11 | 9 | B7 | GAVASGAGL | 3159 | 12.000 |
| 7 | HCV-1a | 3 | 5 | 9 | B7 | LPPRPRHTL | 3160 | 180.000 |
| 8 | HCV-1a | 3 | 8 | 9 | B7 | RPRHTLQGC | 3161 | 20.000 |
| 9 | HCV-1a | 3 | 5 | 9 | B_3501 | LPPRPRHTL | 3162 | 20.000 |
| 10 | HCV-1a | 3 | 8 | 9 | B_3501 | RPRHTLQGC | 3163 | 12.000 |
| 11 | HCV-1a | 3 | 8 | 10 | B7 | RPRHTLQGCL | 3164 | 800.000 |
| 12 | HCV-1a | 3 | 8 | 10 | B_3501 | RPRHTLQGCL | 3164 | 120.000 |
| 13 | HCV-1a | 3 | 3 | 10 | B_4403 | QELPPRPRHT | 3165 | 16.000 |
| 14 | HCV-1a | 4 | 10 | 9 | A_0201 | ALTSPPSIV | 3166 | 28.516 |
| 15 | HCV-1a | 4 | 2 | 9 | A_0201 | KQWRGYQAA | 3167 | 21.949 |
| 16 | HCV-1a | 4 | 2 | 10 | A_0201 | KQWRGYQAAL | 3168 | 62.920 |
| 17 | HCV-1a | 5 |  |  |  | NO HITS |  |  |

TABLE 4b-continued 1a (4-6)

| No. | Strain | ORF | Start | AA | HLA | Peptide sequence | SEQ ID NO | Score |
|---|---|---|---|---|---|---|---|---|
| 18 | HCV-1a | 6 | 12 | 10 | A_0201 | LLCHKRPPST | 3170 | 12.668 |
| 19 | HCV-1a | 6 | 3 | 10 | B7 | HPWSGTRHKL | 3171 | 120.000 |
| 20 | HCV-1a | 6 | 3 | 10 | B_3501 | HPWSGTRHKL | 3172 | 20.000 |
| 21 | HCV-1a | 7 | 4 | 9 | B7 | GPWCFCRCL | 3173 | 80.000 |
| 22 | HCV-1a | 7 | 18 | 9 | B7 | EPPGSSGAL | 3174 | 80.000 |
| 23 | HCV-1a | 7 | 4 | 9 | B_3501 | GPWCFCRCL | 3175 | 20.000 |
| 24 | HCV-1a | 7 | 18 | 9 | B_3501 | EPPGSSGAL | 3176 | 20.000 |
| 25 | HCV-1a | 7 | 18 | 10 | B7 | EPPGSSGALL | 3177 | 80.000 |
| 26 | HCV-1a | 7 | 18 | 10 | B_3501 | EPPGSSGALL | 3178 | 20.000 |
| 27 | HCV-1a | 7 | 4 | 10 | B_3501 | GPWCFCRCLW | 3179 | 10.000 |
| 28 | HCV-1a | 7 | 23 | 10 | B_4403 | SGALLVERSY | 3180 | 18.000 |
| 29 | HCV-1a | 8 | 12 | 9 | A_0201 | QGLDLHWYT | 3181 | 30.440 |
| 30 | HCV-1a | 8 | 6 | 9 | B7 | AERASPQGL | 3182 | 12.000 |
| 31 | HCV-1a | 8 | 8 | 9 | B7 | RASPQGLDL | 3183 | 12.000 |
| 32 | HCV-1a | 8 | 10 | 9 | B_3501 | SPQGLDLHW | 3184 | 10.000 |
| 33 | HCV-1a | 8 | 10 | 10 | B_3501 | SPQGLDLHWY | 3185 | 60.000 |
| 34 | HCV-1a | 8 | 10 | 10 | B_4403 | SPQGLDLHWY | 3186 | 13.500 |
| 35 | HCV-1a | 9 | 2 | 9 | A1 | VTELAPSTR | 3187 | 22.500 |
| 36 | HCV-1a | 9 | 51 | 9 | B7 | APTYPSDTM | 3188 | 90.000 |
| 37 | HCV-1a | 9 | 41 | 9 | B7 | TSRRRCRPL | 3189 | 40.000 |
| 38 | HCV-1a | 9 | 41 | 9 | B8 | TSRRRCRPL | 3190 | 80.000 |
| 39 | HCV-1a | 9 | 51 | 9 | B_3501 | APTYPSDTM | 3191 | 40.000 |
| 40 | HCV-1a | 9 | 41 | 9 | B_3501 | TSRRRCRPL | 3192 | 15.000 |
| 41 | HCV-1a | 9 | 2 | 10 | A1 | VTELAPSTRR | 3193 | 22.500 |
| 42 | HCV-1a | 9 | 40 | 10 | B7 | ATSRRRCRPL | 3194 | 12.000 |
| 43 | HCV-1a | 9 | 45 | 10 | B_3501 | RCRPLRAPTY | 3195 | 12.000 |
| 44 | HCV-1a | 9 | 50 | 10 | B_3501 | RAPTYPSDTM | 3196 | 12.000 |
| 45 | HCV-1a | 10 | 14 | 9 | B7 | SAGCCCPPL | 3197 | 12.000 |
| 46 | HCV-1a | 11 | 3 | 10 | A1 | CGDPLYGRDR | 3198 | 12.500 |
| 47 | HCV-1a | 12 | 8 | 9 | A1 | VLEAARHSY | 3199 | 45.000 |
| 48 | HCV-1a | 12 | 1 | 9 | B7 | MALPGGGVL | 3200 | 12.000 |
| 49 | HCV-1a | 12 | 2 | 10 | A_0201 | ALPGGGVLEA | 3201 | 11.426 |
| 50 | HCV-1a | 13 | 2 | 9 | A_0201 | RLTDLSQLA | 3202 | 20.369 |
| 51 | HCV-1a | 13 | 71 | 9 | A_0201 | SVYPNLHRL | 3203 | 13.757 |
| 52 | HCV-1a | 13 | 68 | 9 | A24 | RGRSVYPNL | 3204 | 11.200 |
| 53 | HCV-1a | 13 | 68 | 9 | B7 | RGRSVYPNL | 3205 | 40.000 |
| 54 | HCV-1a | 13 | 71 | 9 | B7 | SVYPNLHRL | 3206 | 20.000 |
| 55 | HCV-1a | 13 | 2 | 10 | A_0201 | RLTDLSQLAV | 3207 | 285.163 |
| 56 | HCV-1a | 13 | 70 | 10 | A24 | RSVYPNLHRL | 3208 | 12.000 |
| 57 | HCV-1a | 13 | 11 | 10 | B7 | VTRAKMEPPL | 3209 | 40.000 |
| 58 | HCV-1a | 13 | 70 | 10 | B_3501 | RSVYPNLHRL | 3210 | 10.000 |
| 59 | HCV-1a | 14 | 6 | 9 | B7 | ASRSRQNQI | 3211 | 12.000 |
| 60 | HCV-1a | 14 | 6 | 9 | B8 | ASRSRQNQI | 3212 | 20.000 |
| 61 | HCV-1a | 15 | 29 | 9 | A24 | SFLRHAATL | 3213 | 30.000 |
| 62 | HCV-1a | 15 | 7 | 9 | B7 | FLRHAATLL | 3214 | 120.000 |
| 63 | HCV-1a | 15 | 30 | 9 | B7 | FLRHAATLL | 3215 | 40.000 |
| 64 | HCV-1a | 15 | 3 | 9 | B7 | ALPPLARSL | 3216 | 12.000 |
| 65 | HCV-1a | 15 | 7 | 9 | B8 | LARSLARTL | 3217 | 16.000 |
| 66 | HCV-1a | 15 | 29 | 10 | A24 | SFLRHAATLL | 3218 | 30.000 |
| 67 | HCV-1a | 15 | 11 | 10 | B7 | LARTLRARCL | 3219 | 120.000 |
| 68 | HCV-1a | 15 | 2 | 10 | B7 | AALPPLARSL | 3220 | 36.000 |
| 69 | HCV-1a | 15 | 11 | 10 | B8 | LARTLRARCL | 3221 | 320.000 |
| 70 | HCV-1a | 16 | | | | No hits | | |
| 71 | HCV-1a | 17 | 13 | 9 | A_0201 | CLAVSHAAL | 3222 | 21.362 |
| 72 | HCV-1a | 17 | 1 | 9 | A_0201 | MIMLPSQEL | 3223 | 18.476 |
| 73 | HCV-1a | 17 | 2 | 9 | A_0201 | IMLPSQELT | 3224 | 16.588 |
| 74 | HCV-1a | 17 | 1 | 9 | B7 | MIMLPSQEL | 3225 | 18.000 |
| 75 | HCV-1a | 17 | 7 | 9 | B_4403 | QELTGVCLA | 3226 | 24.000 |
| 76 | HCV-1a | 17 | 3 | 10 | A_0201 | MLPSQELTGV | 3227 | 271.948 |
| 77 | HCV-1a | 17 | 7 | 10 | B_4403 | QELTGVCLAV | 3228 | 12.000 |
| 78 | HCV-1a | 18 | 18 | 9 | A_0201 | YLVIASVKA | 3229 | 22.853 |
| 79 | HCV-1a | 18 | 58 | 9 | B7 | AARQAARAL | 3230 | 360.000 |
| 80 | HCV-1a | 18 | 30 | 9 | B7 | AASSWTPAL | 3231 | 36.000 |
| 81 | HCV-1a | 18 | 19 | 9 | B7 | LVIASVKAL | 3232 | 20.000 |
| 82 | HCV-1a | 18 | 21 | 9 | B7 | IASVKALRL | 3233 | 12.000 |
| 83 | HCV-1a | 18 | 58 | 9 | B8 | AARQAARAL | 3234 | 16.000 |
| 84 | HCV-1a | 18 | 21 | 9 | B8 | IASVKALRL | 3235 | 16.000 |
| 85 | HCV-1a | 18 | 16 | 9 | B_4403 | AEYLVIASV | 3236 | 12.000 |
| 86 | HCV-1a | 18 | 18 | 10 | A_0201 | YLVIASVKAL | 3237 | 226.014 |
| 87 | HCV-1a | 18 | 58 | 10 | B7 | AARQAARALM | 3238 | 135.000 |
| 88 | HCV-1a | 18 | 29 | 10 | B7 | LAASSWTPAL | 3239 | 12.000 |
| 89 | HCV-1a | 18 | 58 | 10 | B_3501 | AARQAARALM | 3240 | 18.000 |
| 90 | HCV-1a | 18 | 12 | 10 | B_3501 | SPGGAEYLVI | 3241 | 12.000 |
| 91 | HCV-1a | 18 | 46 | 10 | B_3501 | SPHTSMVQSW | 3242 | 10.000 |
| 92 | HCV-1a | 19 | | | | NO HITS | | |

TABLE 4b-continued 1a (4-6)

| No. | Strain | ORF | Start | AA | HLA | Peptide sequence | SEQ ID NO | Score |
|---|---|---|---|---|---|---|---|---|
| 93 | HCV-1a | 20 | 15 | 9 | A_0201 | YENPIGVFL | 3243 | 10.509 |
| 94 | HCV-1a | 20 | 13 | 9 | A_0201 | VSYENPIGV | 3244 | 10.126 |
| 95 | HCV-1a | 20 | 14 | 9 | A24 | SYENPIGVF | 3245 | 150.000 |
| 96 | HCV-1a | 20 | 2 | 9 | A3 | SLSVTVESK | 3246 | 60.000 |
| 97 | HCV-1a | 20 | 17 | 9 | B_3501 | NPIGVFLDF | 3247 | 20.000 |
| 98 | HCV-1a | 20 | 31 | 9 | B_3501 | NSTRCPGEY | 3248 | 10.000 |
| 99 | HCV-1a | 20 | 7 | 9 | B_4403 | VESKQRVSY | 3249 | 120.000 |
| 100 | HCV-1a | 20 | 17 | 9 | B_4403 | NPIGVFLDF | 3250 | 11.250 |
| 101 | HCV-1a | 20 | 6 | 10 | A1 | TVESKQRVSY | 3251 | 90.000 |
| 102 | HCV-1a | 20 | 14 | 10 | A24 | SYENPIGVFL | 3252 | 420.000 |
| 103 | HCV-1a | 20 | 13 | 10 | B_3501 | VSYENPIGVF | 3253 | 10.000 |
| 104 | HCV-1a | 21 | | | | NO HITS | | |
| 105 | HCV-1a | 22 | | | | NO HITS | | |
| 106 | HCV-1a | 23 | | | | NO HITS | | |
| 107 | HCV-1a | 24 | 1 | 9 | A1 | MPEVEELPK | 3254 | 22.500 |
| 108 | HCV-1a | 24 | 17 | 9 | A_0201 | KAVDRVDSV | 3255 | 15.623 |
| 109 | HCV-1a | 24 | 11 | 9 | A_0201 | LVASSAKAV | 3256 | 10.346 |
| 110 | HCV-1a | 24 | 9 | 9 | A3 | KLLVASSAK | 3257 | 90.000 |
| 111 | HCV-1a | 24 | 5 | 9 | B_4403 | EELPKLLVA | 3258 | 36.000 |
| 112 | HCV-1a | 24 | 10 | 10 | A_0201 | LLVASSAKAV | 3259 | 118.238 |
| 113 | HCV-1a | 24 | 9 | 10 | A_0201 | KLLVASSAKA | 3260 | 64.336 |
| 114 | HCV-1a | 24 | 1 | 10 | B7 | MPEVEELPKL | 3261 | 24.000 |
| 115 | HCV-1a | 24 | 5 | 10 | B_4403 | EELPKLLVAS | 3262 | 24.000 |
| 116 | HCV-1a | 24 | 23 | 10 | B_4403 | DSVRTTVRFF | 3263 | 18.000 |
| 117 | HCV-1a | 25 | 46 | 9 | A1 | GGDPLANLR | 3264 | 12.500 |
| 118 | HCV-1a | 25 | 82 | 9 | A1 | NCDPTGYSW | 3265 | 10.000 |
| 119 | HCV-1a | 25 | 60 | 9 | A_0201 | VIWEGSVSM | 3266 | 39.518 |
| 120 | HCV-1a | 25 | 7 | 9 | A_0201 | CLHRRLASM | 3267 | 11.426 |
| 121 | HCV-1a | 25 | 102 | 9 | A24 | KGLQGGANL | 3268 | 12.000 |
| 122 | HCV-1a | 25 | 23 | 9 | A3 | WLAVQVALR | 3269 | 12.000 |
| 123 | HCV-1a | 25 | 42 | 9 | B7 | LATEGGDPL | 3270 | 12.000 |
| 124 | HCV-1a | 25 | 54 | 9 | B_3501 | RPAASAVIW | 3271 | 20.000 |
| 125 | HCV-1a | 25 | 43 | 10 | A1 | ATEGGDPLAN | 3272 | 11.250 |
| 126 | HCV-1a | 25 | 29 | 10 | A_0201 | ALRDGADSWL | 3273 | 36.611 |
| 127 | HCV-1a | 25 | 103 | 10 | A3 | GLQGGANLCR | 3274 | 36.000 |
| 128 | HCV-1a | 25 | 1 | 10 | A3 | MLPPISCLHR | 3275 | 12.000 |
| 129 | HCV-1a | 25 | 29 | 10 | B7 | ALRDGADSWL | 3276 | 120.000 |
| 130 | HCV-1a | 25 | 59 | 10 | B7 | AVIWEGSVSM | 3277 | 15.000 |
| 131 | HCV-1a | 25 | 29 | 10 | B8 | ALRDGADSWL | 3278 | 12.000 |
| 132 | HCV-1a | 25 | 20 | 10 | B_4403 | GESWLAVQVA | 3279 | 18.000 |
| 133 | HCV-1a | 26 | 12 | 9 | A_0201 | VLGPTILIV | 3280 | 111.499 |
| 134 | HCV-1a | 26 | 62 | 9 | A_0201 | GMSLAFSQV | 3281 | 95.441 |
| 135 | HCV-1a | 26 | 22 | 9 | A_0201 | FLTCPVISA | 3282 | 52.561 |
| 136 | HCV-1a | 26 | 9 | 9 | A_0201 | FLQVLGPTI | 3283 | 47.991 |
| 137 | HCV-1a | 26 | 16 | 9 | A_0201 | TILIVPFLT | 3284 | 21.989 |
| 138 | HCV-1a | 26 | 113 | 9 | A_0201 | LLSMAVTRA | 3285 | 19.425 |
| 139 | HCV-1a | 26 | 17 | 9 | A_0201 | ILIVPFLTC | 3286 | 16.047 |
| 140 | HCV-1a | 26 | 101 | 9 | A_0201 | WCSRLRSWV | 3287 | 11.487 |
| 141 | HCV-1a | 26 | 19 | 9 | A_0201 | IVPFLTCPV | 3288 | 10.346 |
| 142 | HCV-1a | 26 | 66 | 9 | A24 | AFSQVLKSL | 3289 | 28.000 |
| 143 | HCV-1a | 26 | 104 | 9 | A3 | RLRSWVTVR | 3290 | 36.000 |
| 144 | HCV-1a | 26 | 64 | 9 | A3 | SLAFSQVLK | 3291 | 20.000 |
| 145 | HCV-1a | 26 | 30 | 9 | B7 | APQWQRVCM | 3292 | 90.000 |
| 146 | HCV-1a | 26 | 39 | 9 | B7 | MPSPRQTPL | 3293 | 80.000 |
| 147 | HCV-1a | 26 | 57 | 9 | B7 | IPGSCGMSL | 3294 | 80.000 |
| 148 | HCV-1a | 26 | 117 | 9 | B7 | AVTRAAASL | 3295 | 60.000 |
| 149 | HCV-1a | 26 | 110 | 9 | B7 | TVRLLSMAV | 3296 | 10.000 |
| 150 | HCV-1a | 26 | 39 | 9 | B8 | MPSPRQTPL | 3297 | 16.000 |
| 151 | HCV-1a | 26 | 30 | 9 | B_3501 | APQWQRVCM | 3298 | 40.000 |
| 152 | HCV-1a | 26 | 39 | 9 | B_3501 | MPSPRQTPL | 3299 | 20.000 |
| 153 | HCV-1a | 26 | 14 | 9 | B_3501 | GPTILIVPF | 3300 | 20.000 |
| 154 | HCV-1a | 26 | 57 | 9 | B_3501 | IPGSCGMSL | 3301 | 20.000 |
| 155 | HCV-1a | 26 | 25 | 9 | B_3501 | CPVISAPQW | 3302 | 10.000 |
| 156 | HCV-1a | 26 | 106 | 9 | B_3501 | RSWVTVRLL | 3303 | 10.000 |
| 157 | HCV-1a | 26 | 95 | 10 | A1 | HSELIHWCSR | 3304 | 13.500 |
| 158 | HCV-1a | 26 | 84 | 10 | A_0201 | SLSQEPEHGV | 3305 | 69.552 |
| 159 | HCV-1a | 26 | 112 | 10 | A_0201 | RLLSMAVTRA | 3306 | 42.278 |
| 160 | HCV-1a | 26 | 3 | 10 | A_0201 | KVPLHMFLQV | 3307 | 40.471 |
| 161 | HCV-1a | 26 | 9 | 10 | A_0201 | FLQVLGPTIL | 3308 | 40.289 |
| 162 | HCV-1a | 26 | 27 | 10 | A_0201 | VISAPQWRV | 3309 | 27.638 |
| 163 | HCV-1a | 26 | 38 | 10 | A_0201 | MMPSPRQTPL | 3310 | 26.228 |
| 164 | HCV-1a | 26 | 62 | 10 | A_0201 | GMSLAFSQVL | 3311 | 24.037 |
| 165 | HCV-1a | 26 | 11 | 10 | A_0201 | QVLGPTILIV | 3312 | 21.234 |
| 166 | HCV-1a | 26 | 104 | 10 | A24 | RLRSWVTVRL | 3313 | 11.200 |
| 167 | HCV-1a | 26 | 46 | 10 | A3 | PLYPRWQDTK | 3314 | 45.000 |

TABLE 4b-continued 1a (4-6)

| No. | Strain | ORF | Start | AA | HLA | Peptide sequence | SEQ ID NO | Score |
|---|---|---|---|---|---|---|---|---|
| 168 | HCV-1a | 26 | 14 | 10 | B7 | GPTILIVPFL | 3315 | 80.000 |
| 169 | HCV-1a | 26 | 4 | 10 | B7 | VPLHMFLQVL | 3316 | 80.000 |
| 170 | HCV-1a | 26 | 48 | 10 | B7 | YPRWQDTKGI | 3317 | 80.000 |
| 171 | HCV-1a | 26 | 30 | 10 | B7 | APQWQRVCMM | 3318 | 60.000 |
| 172 | HCV-1a | 26 | 104 | 10 | B7 | RLRSWVTVRL | 3319 | 40.000 |
| 173 | HCV-1a | 26 | 65 | 10 | B7 | LAFSQVLKSL | 3320 | 12.000 |
| 174 | HCV-1a | 26 | 116 | 10 | B7 | MAVTRAAASL | 3321 | 12.000 |
| 175 | HCV-1a | 26 | 30 | 10 | B_3501 | APQWQRVCMM | 3322 | 40.000 |
| 176 | HCV-1a | 26 | 39 | 10 | B_3501 | MPSPRQTPLY | 3323 | 40.000 |
| 177 | HCV-1a | 26 | 48 | 10 | B_3501 | YPRWQDTKGI | 3324 | 36.000 |
| 178 | HCV-1a | 26 | 4 | 10 | B_3501 | VPLHMFLQVL | 3325 | 20.000 |
| 179 | HCV-1a | 26 | 14 | 10 | B_3501 | GPTILIVPFL | 3326 | 20.000 |
| 180 | HCV-1a | 26 | 96 | 10 | B_4403 | SELIHWCSRL | 3327 | 24.000 |
| 181 | HCV-1a | 26 | 87 | 10 | B_4403 | QEPEHGVVHS | 3328 | 12.000 |
| 182 | HCV-1a | 27 | 70 | 9 | A1 | ATHPPNMLK | 3329 | 25.000 |
| 183 | HCV-1a | 27 | 75 | 9 | A_0201 | NMLKRRVWL | 3330 | 313.968 |
| 184 | HCV-1a | 27 | 127 | 9 | A_0201 | KVSSFCQLV | 3331 | 80.941 |
| 185 | HCV-1a | 27 | 76 | 9 | A_0201 | MLKRRVWLV | 3332 | 71.386 |
| 186 | HCV-1a | 27 | 80 | 9 | A_0201 | RVWLVVSGL | 3333 | 35.683 |
| 187 | HCV-1a | 27 | 95 | 9 | A_0201 | AINEAMAGL | 3334 | 27.699 |
| 188 | HCV-1a | 27 | 82 | 9 | A_0201 | WLVVSGLVT | 3335 | 14.054 |
| 189 | HCV-1a | 27 | 112 | 9 | A24 | KYCIPLMKF | 3336 | 220.000 |
| 190 | HCV-1a | 27 | 80 | 9 | A24 | RVWLVVSGL | 3337 | 11.200 |
| 191 | HCV-1a | 27 | 123 | 9 | A24 | CFAQKVSSF | 3338 | 10.000 |
| 192 | HCV-1a | 27 | 45 | 9 | A3 | TLPMAAPAK | 3339 | 20.000 |
| 193 | HCV-1a | 27 | 30 | 9 | B7 | APYPARMSM | 3340 | 90.000 |
| 194 | HCV-1a | 27 | 109 | 9 | B7 | KPAKYCIPL | 3341 | 80.000 |
| 195 | HCV-1a | 27 | 69 | 9 | B7 | AATHPPNML | 3342 | 54.000 |
| 196 | HCV-1a | 27 | 80 | 9 | B7 | RVWLVVSGL | 3343 | 20.000 |
| 197 | HCV-1a | 27 | 28 | 9 | B7 | TPAPYPARM | 3344 | 20.000 |
| 198 | HCV-1a | 27 | 92 | 9 | B7 | AVKAINEAM | 3345 | 15.000 |
| 199 | HCV-1a | 27 | 95 | 9 | B7 | AINEAMAGL | 3346 | 12.000 |
| 200 | HCV-1a | 27 | 76 | 9 | B8 | MLKRRVWLV | 3347 | 24.000 |
| 201 | HCV-1a | 27 | 30 | 9 | B_3501 | APYPARMSM | 3348 | 40.000 |
| 202 | HCV-1a | 27 | 28 | 9 | B_3501 | TPAPYPARM | 3349 | 40.000 |
| 203 | HCV-1a | 27 | 109 | 9 | B_3501 | KPAKYCIPL | 3350 | 40.000 |
| 204 | HCV-1a | 27 | 105 | 9 | B_3501 | GSVDKPAKY | 3351 | 20.000 |
| 205 | HCV-1a | 27 | 24 | 9 | B_3501 | RAPATPAPY | 3352 | 12.000 |
| 206 | HCV-1a | 27 | 9 | 9 | B_3501 | SSVEGTSPL | 3353 | 10.000 |
| 207 | HCV-1a | 27 | 105 | 9 | B_4403 | GSVDKPAKY | 3354 | 13.500 |
| 208 | HCV-1a | 27 | 70 | 10 | A1 | ATHPPNMLKR | 3355 | 12.500 |
| 209 | HCV-1a | 27 | 75 | 10 | A_0201 | NMLKRRVWLV | 3356 | 3.206.057 |
| 210 | HCV-1a | 27 | 82 | 10 | A_0201 | WLVVSGLVTA | 3357 | 52.561 |
| 211 | HCV-1a | 27 | 87 | 10 | A_0201 | GLVTAAVKAI | 3358 | 23.995 |
| 212 | HCV-1a | 27 | 19 | 10 | A_0201 | ILNATRAPAT | 3359 | 12.668 |
| 213 | HCV-1a | 27 | 84 | 10 | A_0201 | VVSGLVTAAV | 3360 | 10.346 |
| 214 | HCV-1a | 27 | 94 | 10 | A24 | KAINEAMAGL | 3361 | 12.000 |
| 215 | HCV-1a | 27 | 37 | 10 | B7 | SMRTFPSPTL | 3362 | 60.000 |
| 216 | HCV-1a | 27 | 109 | 10 | B7 | KPAKYCIPLM | 3363 | 20.000 |
| 217 | HCV-1a | 27 | 68 | 10 | B7 | WAATHPPNML | 3364 | 18.000 |
| 218 | HCV-1a | 27 | 94 | 10 | B7 | KAINEAMAGL | 3365 | 12.000 |
| 219 | HCV-1a | 27 | 125 | 10 | B7 | AQKVSSFCQL | 3366 | 12.000 |
| 220 | HCV-1a | 27 | 109 | 10 | B_3501 | KPAKYCIPLM | 3367 | 80.000 |
| 221 | HCV-1a | 27 | 115 | 10 | B_3501 | IPLMKFHICF | 3368 | 20.000 |
| 222 | HCV-1a | 27 | 32 | 10 | B_3501 | YPARMSMRTF | 3369 | 20.000 |
| 223 | HCV-1a | 27 | 9 | 10 | B_3501 | SSVEGTSPLM | 3370 | 20.000 |
| 224 | HCV-1a | 27 | 8 | 10 | B_3501 | RSSVEGTSPL | 3371 | 10.000 |
| 225 | HCV-1a | 27 | 97 | 10 | B_4403 | NEAMAGLPGS | 3372 | 12.000 |
| 226 | HCV-1a | 28 | 44 | 9 | A1 | SADMHVMMY | 3373 | 125.000 |
| 227 | HCV-1a | 28 | 15 | 9 | A1 | TTQPVDRQY | 3374 | 12.500 |
| 228 | HCV-1a | 28 | 52 | 9 | A_0201 | YLVTGCVRV | 3375 | 319.939 |
| 229 | HCV-1a | 28 | 49 | 9 | A_0201 | VMMYLVTGC | 3376 | 51.908 |
| 230 | HCV-1a | 28 | 50 | 9 | A_0201 | MMYLVTGCV | 3377 | 35.524 |
| 231 | HCV-1a | 28 | 30 | 9 | B7 | TPPTSTQVL | 3378 | 80.000 |
| 232 | HCV-1a | 28 | 27 | 9 | B7 | AARTPPTST | 3379 | 13.500 |
| 233 | HCV-1a | 28 | 3 | 9 | B7 | AGFPDKTTL | 3380 | 12.000 |
| 234 | HCV-1a | 28 | 43 | 9 | B_3501 | RSADMHVMM | 3381 | 40.000 |
| 235 | HCV-1a | 28 | 30 | 9 | B_3501 | TPPTSTQVL | 3382 | 20.000 |
| 236 | HCV-1a | 28 | 44 | 9 | B_4403 | SADMHVMMY | 3383 | 18.000 |
| 237 | HCV-1a | 28 | 10 | 10 | A_0201 | TLPTMTTQPV | 3384 | 69.552 |
| 238 | HCV-1a | 28 | 49 | 10 | A_0201 | VMMYLVTGCV | 3385 | 41.075 |
| 239 | HCV-1a | 28 | 29 | 10 | A24 | RTPPTSTQVL | 3386 | 17.280 |
| 240 | HCV-1a | 28 | 50 | 10 | A3 | MMYLVTGCVR | 3387 | 20.000 |
| 241 | HCV-1a | 28 | 2 | 10 | B7 | IAGFPDKTTL | 3388 | 12.000 |
| 242 | HCV-1a | 28 | 41 | 10 | B7 | TSRSADMHVM | 3389 | 10.000 |

TABLE 4b-continued 1a (4-6)

| No. | Strain | ORF | Start | AA | HLA | Peptide sequence | SEQ ID NO | Score |
|---|---|---|---|---|---|---|---|---|
| 243 | HCV-1a | 28 | 24 | 10 | B8 | AAKAARTPPT | 3390 | 16.000 |
| 244 | HCV-1a | 28 | 41 | 10 | B_3501 | TSRSADMHVM | 3391 | 45.000 |
| 245 | HCV-1a | 28 | 43 | 10 | B_3501 | RSADMHVMMY | 3392 | 40.000 |
| 246 | HCV-1a | 28 | 5 | 10 | B_3501 | FPDKTTLPTM | 3393 | 12.000 |
| 247 | HCV-1a | 28 | 43 | 10 | B_4403 | RSADMHVMMY | 3394 | 18.000 |
| 248 | HCV-1a | 29 | 5 | 9 | A_0201 | SLTVVSAGV | 3395 | 69.552 |
| 249 | HCV-1a | 30 | 3 | 10 | B7 | EGRSPGATNL | 3396 | 40.000 |
| 250 | HCV-1a | 31 | 1 | 9 | B7 | MPGFPLPVL | 3397 | 120.000 |
| 251 | HCV-1a | 31 | 1 | 9 | B_3501 | MPGFPLPVL | 3398 | 20.000 |
| 252 | HCV-1a | 32 | 20 | 9 | A_0201 | SITESKSPV | 3399 | 39.210 |
| 253 | HCV-1a | 32 | 17 | 9 | A3 | VLQSITESK | 3400 | 30.000 |
| 254 | HCV-1a | 32 | 3 | 10 | A_0201 | KVGSRLKSTV | 3401 | 21.300 |
| 255 | HCV-1a | 32 | 9 | 10 | A24 | KSTVWVTHVL | 3402 | 11.200 |
| 256 | HCV-1a | 32 | 9 | 10 | B_3501 | KSTVWVTHVL | 3403 | 10.000 |
| 257 | HCV-1a | 33 | 5 | 9 | B7 | VATTTTSPL | 3404 | 12.000 |
| 258 | HCV-1a | 33 | 4 | 10 | B7 | SVATTTTSPL | 3405 | 20.000 |
| 259 | HCV-1a | 34 | 6 | 9 | A24 | SFAASSSHF | 3406 | 10.000 |
| 260 | HCV-1a | 34 | 6 | 10 | A24 | SFAASSSHFF | 3407 | 10.000 |
| 261 | HCV-1a | 35 | | | | NO HITS | | |
| 262 | HCV-1a | 36 | 7 | 9 | A1 | VTEPGGVAV | 3408 | 45.000 |
| 263 | HCV-1a | 36 | 13 | 9 | B7 | VAVASTTSL | 3409 | 12.000 |
| 264 | HCV-1a | 36 | 34 | 9 | B_3501 | MPKMDVASV | 3410 | 18.000 |
| 265 | HCV-1a | 36 | 8 | 9 | B_4403 | TEPGGVAVA | 3411 | 18.000 |
| 266 | HCV-1a | 36 | 7 | 10 | A1 | VTEPGGVAVA | 3412 | 45.000 |
| 267 | HCV-1a | 36 | 6 | 10 | A_0201 | TVTEPGGVAV | 3413 | 24.952 |
| 268 | HCV-1a | 36 | 12 | 10 | B7 | GVAVASTTSL | 3414 | 20.000 |
| 269 | HCV-1a | 36 | 28 | 10 | B7 | WSRTVPMPKM | 3415 | 15.000 |
| 270 | HCV-1a | 36 | 28 | 10 | B_3501 | WSRTVPMPKM | 3416 | 30.000 |
| 271 | HCV-1a | 36 | 25 | 10 | B_3501 | VSAWSRTVPM | 3417 | 10.000 |
| 272 | HCV-1a | 36 | 8 | 10 | B_4403 | TEPGGVAVAS | 3418 | 13.500 |
| 273 | HCV-1a | 37 | 7 | 9 | A_0201 | IVLTPVLML | 3419 | 27.042 |
| 274 | HCV-1a | 37 | 2 | 9 | A_0201 | GLPVVIVLT | 3420 | 17.140 |
| 275 | HCV-1a | 37 | 1 | 9 | A24 | MGLPVVIVL | 3421 | 10.080 |
| 276 | HCV-1a | 37 | 7 | 9 | B7 | IVLTPVLML | 3422 | 30.000 |
| 277 | HCV-1a | 37 | 5 | 9 | B7 | VVIVLTPVL | 3423 | 20.000 |
| 278 | HCV-1a | 37 | 6 | 10 | A_0201 | VIVLTPVLML | 3424 | 11.485 |
| 279 | HCV-1a | 38 | 17 | 9 | B7 | TPRVHTAAL | 3425 | 800.000 |
| 280 | HCV-1a | 38 | 17 | 9 | B8 | TPRVHTAAL | 3426 | 16.000 |
| 281 | HCV-1a | 38 | 17 | 9 | B_3501 | TPRVHTAAL | 3427 | 60.000 |
| 282 | HCV-1a | 38 | 14 | 10 | A_0201 | ALATPRVHTA | 3428 | 11.426 |
| 283 | HCV-1a | 38 | 16 | 10 | B7 | ATPRVHTAAL | 3429 | 12.000 |
| 284 | HCV-1a | 39 | 12 | 9 | B7 | SPRRRTGMT | 3430 | 20.000 |
| 285 | HCV-1a | 39 | 12 | 9 | B8 | SPRRRTGMT | 3431 | 16.000 |
| 286 | HCV-1a | 39 | 11 | 9 | B_3501 | LSPRRRTGM | 3432 | 10.000 |
| 287 | HCV-1a | 39 | 18 | 10 | A3 | GMTSACLVTR | 3433 | 18.000 |
| 288 | HCV-1a | 39 | 1 | 10 | B7 | MGRGDSRLPL | 3434 | 60.000 |
| 289 | HCV-1a | 40 | 4 | 9 | A_0201 | PLGDAMVLV | 3435 | 14.429 |
| 290 | HCV-1a | 40 | 3 | 9 | B7 | GPLGDAMVL | 3436 | 80.000 |
| 291 | HCV-1a | 40 | 3 | 9 | B_3501 | GPLGDAMVL | 3437 | 30.000 |
| 292 | HCV-1a | 41 | 77 | 9 | A_0201 | LMMSPHAAV | 3438 | 315.959 |
| 293 | HCV-1a | 41 | 22 | 9 | A_0201 | FLSRPVRLV | 3439 | 147.172 |
| 294 | HCV-1a | 41 | 31 | 9 | A_0201 | IMHPRRPLV | 3440 | 85.394 |
| 295 | HCV-1a | 41 | 15 | 9 | A_0201 | WTSPSTWFL | 3441 | 56.299 |
| 296 | HCV-1a | 41 | 6 | 9 | A_0201 | KVWAAVDTI | 3442 | 29.887 |
| 297 | HCV-1a | 41 | 21 | 9 | A24 | WFLSRPVRL | 3443 | 30.000 |
| 298 | HCV-1a | 41 | 61 | 9 | B7 | GPSSISRPL | 3444 | 80.000 |
| 299 | HCV-1a | 41 | 116 | 9 | B7 | QSRRGVRWL | 3445 | 40.000 |
| 300 | HCV-1a | 41 | 30 | 9 | B7 | VIMHPRRPL | 3446 | 27.000 |
| 301 | HCV-1a | 41 | 105 | 9 | B7 | ATARSRKPL | 3447 | 18.000 |
| 302 | HCV-1a | 41 | 43 | 9 | B7 | YAVMGASNL | 3448 | 12.000 |
| 303 | HCV-1a | 41 | 106 | 9 | B8 | TARSRKPLC | 3449 | 16.000 |
| 304 | HCV-1a | 41 | 33 | 9 | B_3501 | HPRRPLVCW | 3450 | 30.000 |
| 305 | HCV-1a | 41 | 61 | 9 | B_3501 | GPSSISRPL | 3451 | 20.000 |
| 306 | HCV-1a | 41 | 116 | 9 | B_3501 | QSRRGVRWL | 3452 | 15.000 |
| 307 | HCV-1a | 41 | 71 | 9 | B_4403 | AETGKPLMM | 3453 | 18.000 |
| 308 | HCV-1a | 41 | 45 | 10 | A_0201 | VMGASNLQPL | 3454 | 60.325 |
| 309 | HCV-1a | 41 | 30 | 10 | A_0201 | VIMHPRRPLV | 3455 | 60.154 |
| 310 | HCV-1a | 41 | 22 | 10 | A_0201 | FLSRPVRLVI | 3456 | 19.676 |
| 311 | HCV-1a | 41 | 42 | 10 | A24 | AYAVMGASNL | 3457 | 200.000 |
| 312 | HCV-1a | 41 | 90 | 10 | A3 | VMSLVSIWEK | 3458 | 90.000 |
| 313 | HCV-1a | 41 | 84 | 10 | B7 | AVSAPHVMSL | 3459 | 60.000 |
| 314 | HCV-1a | 41 | 29 | 10 | B7 | LVIMHPRRPL | 3460 | 45.000 |
| 315 | HCV-1a | 41 | 87 | 10 | B7 | APHVMSLVSI | 3461 | 24.000 |
| 316 | HCV-1a | 41 | 33 | 10 | B7 | HPRRPLVCWA | 3462 | 20.000 |
| 317 | HCV-1a | 41 | 104 | 10 | B7 | TATARSRKPL | 3463 | 18.000 |

TABLE 4b-continued 1a (4-6)

| No. | Strain | ORF | Start | AA | HLA | Peptide sequence | SEQ ID NO | Score |
|---|---|---|---|---|---|---|---|---|
| 318 | HCV-1a | 41 | 115 | 10 | B7 | AQSRRGVRWL | 3464 | 12.000 |
| 319 | HCV-1a | 41 | 60 | 10 | B7 | AGPSSISRPL | 3465 | 12.000 |
| 320 | HCV-1a | 41 | 23 | 10 | B7 | LSRPVRLVIM | 3466 | 10.000 |
| 321 | HCV-1a | 41 | 23 | 10 | B8 | LSRPVRLVIM | 3467 | 20.000 |
| 322 | HCV-1a | 41 | 106 | 10 | B8 | TARSRKPLCA | 3468 | 16.000 |
| 323 | HCV-1a | 41 | 23 | 10 | B_3501 | LSRPVRLVIM | 3469 | 30.000 |
| 324 | HCV-1a | 41 | 71 | 10 | B_4403 | AETGKPLMMS | 3470 | 18.000 |
| 325 | HCV-1a | 42 | 14 | 9 | A3 | KMTASRPPR | 3471 | 12.000 |
| 326 | HCV-1a | 42 | 33 | 9 | B_4403 | CASTLVRKY | 3472 | 13.500 |
| 327 | HCV-1a | 42 | 14 | 10 | A_0201 | KMTASRPPRT | 3473 | 18.837 |
| 328 | HCV-1a | 42 | 19 | 10 | B7 | RPPRTLRGGI | 3474 | 12.000 |
| 329 | HCV-1a | 42 | 3 | 10 | B7 | NTRVGCTAHM | 3475 | 10.000 |
| 330 | HCV-1a | 42 | 19 | 10 | B_3501 | RPPRTLRGGI | 3476 | 16.000 |
| 331 | HCV-1a | 42 | 32 | 10 | B_4403 | SCASTLVRKY | 3477 | 54.000 |
| 332 | HCV-1a | 43 | 33 | 9 | A1 | MLDPTPYKY | 3478 | 500.000 |
| 333 | HCV-1a | 43 | 95 | 9 | A_0201 | VQLQAASSL | 3479 | 13.624 |
| 334 | HCV-1a | 43 | 109 | 9 | A24 | TYILILNIV | 3480 | 12.600 |
| 335 | HCV-1a | 43 | 40 | 9 | A24 | KYCTSTMFW | 3481 | 10.000 |
| 336 | HCV-1a | 43 | 45 | 9 | A3 | TMFWWRWMR | 3482 | 180.000 |
| 337 | HCV-1a | 43 | 32 | 9 | A3 | AMLDPTPYK | 3483 | 45.000 |
| 338 | HCV-1a | 43 | 33 | 9 | A3 | MLDPTPYKY | 3484 | 18.000 |
| 339 | HCV-1a | 43 | 89 | 9 | B7 | SQRSPRVQL | 3485 | 90.000 |
| 340 | HCV-1a | 43 | 106 | 9 | B7 | TPPTYILIL | 3486 | 80.000 |
| 341 | HCV-1a | 43 | 92 | 9 | B7 | SPRVQLQAA | 3487 | 20.000 |
| 342 | HCV-1a | 43 | 71 | 9 | B7 | CVVVSSNGL | 3488 | 20.000 |
| 343 | HCV-1a | 43 | 26 | 9 | B7 | HLMAQDAML | 3489 | 12.000 |
| 344 | HCV-1a | 43 | 106 | 9 | B_3501 | TPPTYILIL | 3490 | 20.000 |
| 345 | HCV-1a | 43 | 53 | 9 | B_3501 | RPVDKAGRV | 3491 | 16.000 |
| 346 | HCV-1a | 43 | 31 | 9 | B_4403 | DAMLDPTPY | 3492 | 27.000 |
| 347 | HCV-1a | 43 | 102 | 10 | A_0201 | SLCSTPPTYI | 3493 | 57.380 |
| 348 | HCV-1a | 43 | 33 | 10 | A_0201 | MLDPTPYKYC | 3494 | 27.870 |
| 349 | HCV-1a | 43 | 94 | 10 | A24 | RVQLQAASSL | 3495 | 12.000 |
| 350 | HCV-1a | 43 | 88 | 10 | A24 | RSQRSPRVQL | 3496 | 12.000 |
| 351 | HCV-1a | 43 | 40 | 10 | A24 | KYCTSTMFWW | 3497 | 10.000 |
| 352 | HCV-1a | 43 | 38 | 10 | A24 | PYKYCTSTMF | 3498 | 10.000 |
| 353 | HCV-1a | 43 | 32 | 10 | A3 | AMLDPTPYKY | 3499 | 18.000 |
| 354 | HCV-1a | 43 | 18 | 10 | B7 | RNRRTTYSHL | 3500 | 40.000 |
| 355 | HCV-1a | 43 | 94 | 10 | B7 | RVQLQAASSL | 3501 | 20.000 |
| 356 | HCV-1a | 43 | 37 | 10 | B7 | TPYKYCTSTM | 3502 | 20.000 |
| 357 | HCV-1a | 43 | 86 | 10 | B8 | SSRSQRSPRV | 3503 | 12.000 |
| 358 | HCV-1a | 43 | 37 | 10 | B_3501 | TPYKYCTSTM | 3504 | 40.000 |
| 359 | HCV-1a | 43 | 15 | 10 | B_3501 | ASRRNRRTTY | 3505 | 30.000 |
| 360 | HCV-1a | 43 | 53 | 10 | B_3501 | RPVDKAGRVV | 3506 | 16.000 |
| 361 | HCV-1a | 43 | 88 | 10 | B_3501 | RSQRSPRVQL | 3507 | 10.000 |
| 362 | HCV-1a | 43 | 101 | 10 | B_3501 | SSLCSTPPTY | 3508 | 10.000 |
| 363 | HCV-1a | 43 | 24 | 10 | B_3501 | YSHLMAQDAM | 3509 | 10.000 |
| 364 | HCV-1a | 43 | 43 | 10 | B_3501 | TSTMFWWRWM | 3510 | 10.000 |
| 365 | HCV-1a | 43 | 30 | 10 | B_4403 | QDAMLDPTPY | 3511 | 45.000 |
| 366 | HCV-1a | 43 | 101 | 10 | B_4403 | SSLCSTPPTY | 3512 | 12.000 |
| 367 | HCV-1a | 44 | 30 | 9 | A_0201 | VLLRTKTSV | 3513 | 437.482 |
| 368 | HCV-1a | 44 | 9 | 9 | A_0201 | TLVNPVEFI | 3514 | 64.668 |
| 369 | HCV-1a | 44 | 16 | 9 | A_0201 | FIQVQPNQL | 3515 | 13.512 |
| 370 | HCV-1a | 44 | 24 | 9 | B7 | LPSGGLVLL | 3516 | 80.000 |
| 371 | HCV-1a | 44 | 6 | 9 | B7 | APHTLVNPV | 3517 | 12.000 |
| 372 | HCV-1a | 44 | 24 | 9 | B_3501 | LPSGGLVLL | 3518 | 20.000 |
| 373 | HCV-1a | 44 | 23 | 10 | A_0201 | QLPSGGLVLL | 3519 | 49.134 |
| 374 | HCV-1a | 44 | 29 | 10 | A_0201 | LVLLRTKTSV | 3520 | 38.280 |
| 375 | HCV-1a | 44 | 10 | 10 | A_0201 | LVNPVEFIQV | 3521 | 19.657 |
| 376 | HCV-1a | 44 | 15 | 10 | A24 | EFIQVQPNQL | 3522 | 36.000 |
| 377 | HCV-1a | 44 | 20 | 10 | B7 | QPNQLPSGGL | 3523 | 120.000 |
| 378 | HCV-1a | 44 | 20 | 10 | B_3501 | QPNQLPSGGL | 3524 | 20.000 |
| 379 | HCV-1a | 45 | | | | NO HITS | | |
| 380 | HCV-1a | 46 | | | | NO HITS | | |
| 381 | HCV-1a | 47 | 8 | 9 | A_0201 | TILELGQSL | 3525 | 44.559 |
| 382 | HCV-1a | 47 | 8 | 9 | A24 | TILELGQSL | 3526 | 10.368 |
| 383 | HCV-1a | 47 | 4 | 9 | B7 | AASYTILEL | 3527 | 36.000 |
| 384 | HCV-1a | 47 | 2 | 9 | B7 | ASAASYTIL | 3528 | 12.000 |
| 385 | HCV-1a | 47 | 10 | 9 | B_4403 | LELGQSLVT | 3529 | 12.000 |
| 386 | HCV-1a | 47 | 8 | 10 | A_0201 | TILELGQSLV | 3530 | 145.077 |
| 387 | HCV-1a | 47 | 1 | 10 | B7 | MASAASYTIL | 3531 | 12.000 |
| 388 | HCV-1a | 47 | 3 | 10 | B7 | SAASYTILEL | 3532 | 12.000 |
| 389 | HCV-1a | 47 | 10 | 10 | B_4403 | LELGQSLVTW | 3533 | 54.000 |
| 390 | HCV-1a | 48 | 42 | 9 | B7 | HPAHPQPSL | 3534 | 120.000 |
| 391 | HCV-1a | 48 | 12 | 9 | B7 | RVSMTLPKL | 3535 | 20.000 |
| 392 | HCV-1a | 48 | 42 | 9 | B_3501 | HPAHPQPSL | 3536 | 20.000 |

TABLE 4b-continued 1a (4-6)

| No. | Strain | ORF | Start | AA | HLA | Peptide sequence | SEQ ID NO | Score |
|---|---|---|---|---|---|---|---|---|
| 393 | HCV-1a | 48 | 8 | 10 | A24 | KPHVRVSMTL | 3537 | 11.200 |
| 394 | HCV-1a | 48 | 8 | 10 | B7 | KPHVRVSMTL | 3538 | 80.000 |
| 395 | HCV-1a | 48 | 35 | 10 | B7 | EPRGDRSHPA | 3539 | 20.000 |
| 396 | HCV-1a | 48 | 2 | 10 | B7 | YPMRSAKPHV | 3540 | 12.000 |
| 397 | HCV-1a | 48 | 35 | 10 | B8 | EPRGDRSHPA | 3541 | 32.000 |
| 398 | HCV-1a | 48 | 19 | 10 | B8 | KLRDLRRGSV | 3542 | 18.000 |
| 399 | HCV-1a | 48 | 8 | 10 | B_3501 | KPHVRVSMTL | 3543 | 40.000 |
| 400 | HCV-1a | 48 | 6 | 10 | B_3501 | SAKPHVRVSM | 3544 | 18.000 |
| 401 | HCV-1a | 49 | 15 | 9 | A24 | PYQAVPQGL | 3545 | 50.400 |
| 402 | HCV-1a | 49 | 22 | 9 | A3 | GLSRPNTTR | 3546 | 18.000 |
| 403 | HCV-1a | 49 | 23 | 9 | B7 | LSRPNTTRL | 3547 | 40.000 |
| 404 | HCV-1a | 49 | 8 | 9 | B_3501 | LPGHSQAPY | 3548 | 40.000 |
| 405 | HCV-1a | 49 | 23 | 9 | B_3501 | LSRPNTTRL | 3549 | 15.000 |
| 406 | HCV-1a | 49 | 22 | 10 | A_0201 | GLSRPNTTRL | 3550 | 21.362 |
| 407 | HCV-1a | 49 | 25 | 10 | A24 | RPNTTRLAVL | 3551 | 12.000 |
| 408 | HCV-1a | 49 | 33 | 10 | A3 | VLRGHAQISR | 3552 | 12.000 |
| 409 | HCV-1a | 49 | 14 | 10 | B7 | APYQAVPQGL | 3553 | 240.000 |
| 410 | HCV-1a | 49 | 25 | 10 | B7 | RPNTTRLAVL | 3554 | 80.000 |
| 411 | HCV-1a | 49 | 25 | 10 | B_3501 | RPNTTRLAVL | 3555 | 40.000 |
| 412 | HCV-1a | 49 | 14 | 10 | B_3501 | APYQAVPQGL | 3556 | 20.000 |
| 413 | HCV-1a | 50 | 4 | 9 | B_4403 | REASISTLC | 3557 | 12.000 |
| 414 | HCV-1a | 50 | 2 | 10 | B7 | ICREASISTL | 3558 | 40.000 |
| 415 | HCV-1a | 50 | 2 | 10 | B8 | ICREASISTL | 3559 | 24.000 |
| 416 | HCV-1a | 50 | 4 | 10 | B_4403 | REASISTLCS | 3560 | 12.000 |
| 417 | HCV-1a | 51 | 29 | 9 | A1 | WSEFELCSY | 3561 | 67.500 |
| 418 | HCV-1a | 51 | 32 | 9 | A_0201 | FELCSYCPV | 3562 | 34.527 |
| 419 | HCV-1a | 51 | 36 | 9 | A24 | SYCPVEEVL | 3563 | 336.000 |
| 420 | HCV-1a | 51 | 72 | 9 | A24 | RYPKFSEAC | 3564 | 15.000 |
| 421 | HCV-1a | 51 | 27 | 9 | A24 | RYWSEFELC | 3565 | 12.000 |
| 422 | HCV-1a | 51 | 65 | 9 | B_3501 | VSPSSQGRY | 3566 | 10.000 |
| 423 | HCV-1a | 51 | 41 | 9 | B_4403 | EEVLATYGS | 3567 | 18.000 |
| 424 | HCV-1a | 51 | 75 | 10 | A24 | KFSEACGHPI | 3568 | 12.000 |
| 425 | HCV-1a | 51 | 27 | 10 | A24 | RYWSEFELCS | 3569 | 10.000 |
| 426 | HCV-1a | 51 | 25 | 10 | B7 | SGRYWSEFEL | 3570 | 40.000 |
| 427 | HCV-1a | 51 | 38 | 10 | B_3501 | CPVEEVLATY | 3571 | 80.000 |
| 428 | HCV-1a | 51 | 77 | 10 | B_4403 | SEACGHPIDF | 3572 | 160.000 |
| 429 | HCV-1a | 51 | 38 | 10 | B_4403 | CPVEEVLATY | 3573 | 13.500 |
| 430 | HCV-1a | 51 | 15 | 10 | B_4403 | REPAGQVQLA | 3574 | 12.000 |
| 431 | HCV-1a | 51 | 59 | 10 | B_4403 | ADAPGPVSPS | 3575 | 12.000 |
| 432 | HCV-1a | 52 | | | | NO HITS | | |
| 433 | HCV-1a | 53 | 8 | 10 | B_3501 | RPQCGGKHDY | 3576 | 80.000 |
| 434 | HCV-1a | 54 | 4 | 9 | B7 | DVFCPITKL | 3577 | 30.000 |
| 435 | HCV-1a | 54 | 2 | 10 | A1 | ATDVFCPITK | 3578 | 125.000 |
| 436 | HCV-1a | 54 | 5 | 10 | A24 | VFCPITKLGF | 3579 | 12.000 |
| 437 | HCV-1a | 55 | 13 | 9 | A_0201 | FLLPLASTA | 3580 | 84.555 |
| 438 | HCV-1a | 55 | 5 | 10 | A_0201 | NLQSVKCDFL | 3581 | 57.572 |
| 439 | HCV-1a | 55 | 6 | 10 | A_0201 | LQSVKCDFLL | 3582 | 21.356 |
| 440 | HCV-1a | 55 | 8 | 10 | B7 | SVKCDFLLPL | 3583 | 20.000 |
| 441 | HCV-1a | 56 | 6 | 9 | A_0201 | FVVGLFPRL | 3584 | 16.337 |
| 442 | HCV-1a | 56 | 6 | 9 | B7 | FVVGLFPRL | 3585 | 20.000 |
| 443 | HCV-1a | 56 | 5 | 10 | A24 | WFVVGLFPRL | 3586 | 43.200 |
| 444 | HCV-1a | 57 | | | | NO HITS | | |
| 445 | HCV-1a | 58 | 9 | 10 | A_0201 | RQHGHVRFGL | 3587 | 12.562 |
| 446 | HCV-1a | 58 | 9 | 10 | A24 | RQHGHVRFGL | 3588 | 11.200 |
| 447 | HCV-1a | 58 | 5 | 10 | B_4403 | SEHGRQHGHV | 3589 | 12.000 |
| 448 | HCV-1a | 59 | 33 | 9 | B7 | DPRQLWHEL | 3590 | 800.000 |
| 449 | HCV-1a | 59 | 19 | 9 | B7 | SPDPLIPAL | 3591 | 24.000 |
| 450 | HCV-1a | 59 | 15 | 9 | B7 | DAVPSPDPL | 3592 | 12.000 |
| 451 | HCV-1a | 59 | 33 | 9 | B8 | DPRQLWHEL | 3593 | 32.000 |
| 452 | HCV-1a | 59 | 33 | 9 | B_3501 | DPRQLWHEL | 3594 | 60.000 |
| 453 | HCV-1a | 59 | 28 | 10 | B7 | AGHKGDPRQL | 3595 | 12.000 |
| 454 | HCV-1a | 60 | 10 | 10 | B7 | QPVHPLHCPL | 3596 | 80.000 |
| 455 | HCV-1a | 60 | 10 | 10 | B_3501 | QPVHPLHCPL | 3597 | 20.000 |
| 456 | HCV-1a | 60 | 19 | 10 | B_3501 | LARANVPAQY | 3598 | 18.000 |
| 457 | HCV-1a | 60 | 6 | 10 | B_4403 | GEGYQPVHPL | 3599 | 12.000 |
| 458 | HCV-1a | 61 | 38 | 9 | A_0201 | LLGEHHPLL | 3600 | 148.896 |
| 459 | HCV-1a | 61 | 27 | 9 | A_0201 | GLQEAEGLL | 3601 | 11.386 |
| 460 | HCV-1a | 61 | 26 | 9 | A24 | RGLQEAEGL | 3602 | 12.000 |
| 461 | HCV-1a | 61 | 15 | 9 | B7 | DSRGDNLCL | 3603 | 40.000 |
| 462 | HCV-1a | 61 | 15 | 9 | B_3501 | DSRGDNLCL | 3604 | 22.500 |
| 463 | HCV-1a | 61 | 31 | 9 | B_4403 | AEGLLLELL | 3605 | 12.000 |
| 464 | HCV-1a | 61 | 27 | 10 | A_0201 | GLQEAEGLLL | 3606 | 87.586 |
| 465 | HCV-1a | 61 | 1 | 10 | A_0201 | MLRPEGLEFL | 3607 | 17.108 |
| 466 | HCV-1a | 61 | 22 | 10 | A_0201 | CLTGRGLQEA | 3608 | 11.426 |
| 467 | HCV-1a | 61 | 26 | 10 | A24 | RGLQEAEGLL | 3609 | 12.000 |

TABLE 4b-continued 1a (4-6)

| No. | Strain | ORF | Start | AA | HLA | Peptide sequence | SEQ ID NO | Score |
|---|---|---|---|---|---|---|---|---|
| 468 | HCV-1a | 61 | 1 | 10 | B7 | MLRPEGLEFL | 3610 | 40.000 |
| 469 | HCV-1a | 61 | 29 | 10 | B_4403 | QEAEGLLLEL | 3611 | 12.000 |
| 470 | HCV-1a | 62 | 37 | 9 | A_0201 | KVLPTLLCL | 3612 | 55.674 |
| 471 | HCV-1a | 62 | 37 | 9 | A24 | KVLPTLLCL | 3613 | 14.400 |
| 472 | HCV-1a | 62 | 29 | 9 | A3 | GLVRYQVRK | 3614 | 270.000 |
| 473 | HCV-1a | 62 | 34 | 9 | B7 | QVRKVLPTL | 3615 | 200.000 |
| 474 | HCV-1a | 62 | 14 | 9 | B7 | LVPRWGRGL | 3616 | 20.000 |
| 475 | HCV-1a | 62 | 37 | 9 | B7 | KVLPTLLCL | 3617 | 20.000 |
| 476 | HCV-1a | 62 | 6 | 9 | B7 | EANQTLPHL | 3618 | 12.000 |
| 477 | HCV-1a | 62 | 30 | 9 | B7 | LVRYQVRKV | 3619 | 10.000 |
| 478 | HCV-1a | 62 | 25 | 9 | B_4403 | SAHGGLVRY | 3620 | 13.500 |
| 479 | HCV-1a | 62 | 29 | 10 | A_0201 | GLVRYQVRKV | 3621 | 31.994 |
| 480 | HCV-1a | 62 | 33 | 10 | A_0201 | YQVRKVLPTL | 3622 | 22.915 |
| 481 | HCV-1a | 62 | 32 | 10 | A24 | RYQVRKVLPT | 3623 | 15.000 |
| 482 | HCV-1a | 62 | 30 | 10 | B7 | LVRYQVRKVL | 3624 | 300.000 |
| 483 | HCV-1a | 62 | 34 | 10 | B7 | QVRKVLPTLL | 3625 | 200.000 |
| 484 | HCV-1a | 62 | 5 | 10 | B_4403 | LEANQTLPHL | 3626 | 12.000 |
| 485 | HCV-1a | 63 | | | | NO HITS | | |
| 486 | HCV-1a | 64 | 3 | 10 | A1 | EDEMSPPLDY | 3627 | 11.250 |
| 487 | HCV-1a | 64 | 76 | 10 | A_0201 | GVALVTNYYV | 3628 | 33.472 |
| 488 | HCV-1a | 64 | 85 | 10 | A_0201 | VISAPRAPAV | 3629 | 16.258 |
| 489 | HCV-1a | 64 | 36 | 10 | A3 | GMGHSDGARR | 3630 | 12.000 |
| 490 | HCV-1a | 64 | 91 | 10 | B7 | APAVGKELAV | 3631 | 12.000 |
| 491 | HCV-1a | 64 | 4 | 10 | B_4403 | DEMSPPLDYF | 3632 | 360.000 |
| 492 | HCV-1a | 64 | 3 | 10 | B_4403 | EDEMSPPLDY | 3633 | 15.000 |
| 493 | HCV-1a | 64 | 75 | 10 | B_4403 | RGVALVTNYY | 3634 | 13.500 |
| 494 | HCV-1a | 64 | 120 | 9 | A1 | RIDPMSLGH | 3635 | 25.000 |
| 495 | HCV-1a | 64 | 77 | 9 | A_0201 | VALVTNYYV | 3636 | 33.419 |
| 496 | HCV-1a | 64 | 90 | 9 | A24 | RAPAVGKEL | 3637 | 18.480 |
| 497 | HCV-1a | 64 | 118 | 9 | B7 | DVRIDPMSL | 3638 | 200.000 |
| 498 | HCV-1a | 64 | 53 | 9 | B7 | QSRPRSLCL | 3639 | 40.000 |
| 499 | HCV-1a | 64 | 90 | 9 | B7 | RAPAVGKEL | 3640 | 12.000 |
| 500 | HCV-1a | 64 | 53 | 9 | B8 | QSRPRSLCL | 3641 | 80.000 |
| 501 | HCV-1a | 64 | 71 | 9 | B8 | GCGIRGVAL | 3642 | 16.000 |
| 502 | HCV-1a | 64 | 53 | 9 | B_3501 | QSRPRSLCL | 3643 | 15.000 |
| 503 | HCV-1a | 64 | 116 | 9 | B_3501 | GPDVRIDPM | 3644 | 12.000 |
| 504 | HCV-1a | 64 | 29 | 9 | B_3501 | QSNLLDVGM | 3645 | 10.000 |
| 505 | HCV-1a | 64 | 4 | 9 | B_4403 | DEMSPPLDY | 3646 | 720.000 |
| 506 | HCV-1a | 64 | 75 | 9 | B_4403 | RGVALVTNY | 3647 | 27.000 |
| 507 | HCV-1a | 65 | 6 | 9 | B_4403 | LEALGHYWW | 3648 | 24.000 |
| 508 | HCV-1a | 65 | 1 | 9 | B_4403 | MEVSHLEAL | 3649 | 12.000 |
| 509 | HCV-1a | 65 | 8 | 10 | A_0201 | ALGHYWWRGV | 3650 | 23.648 |
| 510 | HCV-1a | 65 | 3 | 10 | B_3501 | VSHLEALGHY | 3651 | 10.000 |
| 511 | HCV-1a | 66 | | | | NO HITS | | |
| 512 | HCV-1a | 67 | | | | NO HITS | | |
| 513 | HCV-1a | 68 | 29 | 9 | A_0201 | MLAEAISGA | 3652 | 79.642 |
| 514 | HCV-1a | 68 | 33 | 9 | A_0201 | AISGAVQGV | 3653 | 21.996 |
| 515 | HCV-1a | 68 | 21 | 9 | B7 | APRVCGVRM | 3654 | 600.000 |
| 516 | HCV-1a | 68 | 26 | 9 | B7 | GVRMLAEAI | 3655 | 20.000 |
| 517 | HCV-1a | 68 | 21 | 9 | B_3501 | APRVCGVRM | 3656 | 120.000 |
| 518 | HCV-1a | 68 | 29 | 10 | A_0201 | MLAEAISGAV | 3657 | 63.021 |
| 519 | HCV-1a | 68 | 28 | 10 | A_0201 | RMLAEAISGA | 3658 | 30.534 |
| 520 | HCV-1a | 68 | 21 | 10 | B7 | APRVCGVRML | 3659 | 2.400.000 |
| 521 | HCV-1a | 68 | 21 | 10 | B8 | APRVCGVRML | 3660 | 16.000 |
| 522 | HCV-1a | 68 | 21 | 10 | B_3501 | APRVCGVRML | 3661 | 60.000 |
| 523 | HCV-1a | 68 | 47 | 10 | B_4403 | DDTRRRSAHF | 3662 | 15.000 |

TABLE 4c 1b (1-3)

| No. | Strain | ORF | Start | AA | HLA | Peptide sequence | SEQ ID NO: | Score |
|---|---|---|---|---|---|---|---|---|
| 1 | HCV-1b | 4 | 3 | 9 | A24 | RTTAPTQVL | 3663 | 9.600 |
| 2 | HCV-1b | 5 | 3 | 9 | A24 | RYKIAIAQS | 3664 | 10.000 |
| 3 | HCV-1b | 5 | 3 | 10 | A24 | RYKIAIAQSI | 3665 | 186.000 |
| 4 | HCV-1b | 5 | 15 | 10 | A24 | TYQVTAWLGI | 3666 | 75.000 |
| 5 | HCV-1b | 13 | 3 | 9 | A24 | SFLPMVVAL | 3667 | 36.000 |
| 6 | HCV-1b | 14 | 110 | 9 | A24 | SYQLSETSL | 3668 | 300.000 |
| 7 | HCV-1b | 14 | 26 | 9 | A24 | RGLSCSPPL | 3669 | 12.000 |
| 8 | HCV-1b | 18 | 32 | 9 | A24 | KQPPNKRRL | 3670 | 14.400 |
| 9 | HCV-1b | 18 | 32 | 10 | A24 | KQPPNKRRLL | 3671 | 14.400 |

TABLE 4c-continued 1b (1-3)

| No. | Strain | ORF | Start | AA | HLA | Peptide sequence | SEQ ID NO: | Score |
|---|---|---|---|---|---|---|---|---|
| 10 | HCV-1b | 20 | 13 | 9 | A24 | RSSPALPSL | 3672 | 9.600 |
| 11 | HCV-1b | 20 | 4 | 9 | A24 | RATPQRVLL | 3673 | 9.600 |
| 12 | HCV-1b | 20 | 9 | 10 | A24 | RVLLRSSPAL | 3674 | 12.000 |
| 13 | HCV-1b | 25 | 4 | 9 | A24 | KYPFRRRSC | 3675 | 15.000 |
| 14 | HCV-1b | 29 | 27 | 9 | A24 | VYARRWPSM | 3676 | 25.000 |
| 15 | HCV-1b | 29 | 27 | 10 | A24 | VYARRWPSMM | 3677 | 25.000 |
| 16 | HCV-1b | 30 | 9 | 9 | A24 | RSPRTTSVL | 3678 | 12.000 |
| 17 | HCV-1b | 33 | 27 | 10 | A24 | GYHPCESGDI | 3679 | 60.000 |
| 18 | HCV-1b | 36 | 57 | 9 | A24 | LFDHPSFRL | 3680 | 20.000 |
| 19 | HCV-1b | 36 | 46 | 9 | A24 | LFLYLPLSF | 3681 | 18.000 |
| 20 | HCV-1b | 36 | 44 | 9 | A24 | RLLFLYLPL | 3682 | 14.400 |
| 21 | HCV-1b | 36 | 48 | 9 | A24 | LYLPLSFAV | 3683 | 10.800 |
| 22 | HCV-1b | 36 | 48 | 10 | A24 | LYLPLSFAVL | 3684 | 432.000 |
| 23 | HCV-1b | 40 | 29 | 10 | A24 | GFCRSGTLDL | 3685 | 20.000 |
| 24 | HCV-1b | 41 | 6 | 9 | A24 | FYHQGRGAL | 3686 | 200.000 |
| 25 | HCV-1b | 41 | 5 | 10 | A24 | IFYHQGRGAL | 3687 | 20.000 |
| 26 | HCV-1b | 47 | 13 | 9 | A24 | TYAARANTL | 3688 | 240.000 |
| 27 | HCV-1b | 53 | 10 | 9 | A24 | RCIRQKGVL | 3689 | 12.000 |
| 28 | HCV-1b | 8 | 3 | 9 | A3 | RLWPERMAF | 3690 | 30.000 |
| 29 | HCV-1b | 8 | 33 | 9 | A3 | HMLSMAYGR | 3691 | 18.000 |
| 30 | HCV-1b | 14 | 60 | 9 | A3 | SMAKPSPLK | 3692 | 30.000 |
| 31 | HCV-1b | 14 | 27 | 9 | A3 | GLSCSPPLR | 3693 | 12.000 |
| 32 | HCV-1b | 14 | 54 | 10 | A3 | ILERSPSMAK | 3694 | 60.000 |
| 33 | HCV-1b | 29 | 35 | 9 | A3 | MMWSPPFLR | 3695 | 90.000 |
| 34 | HCV-1b | 29 | 22 | 9 | A3 | QIWESVYAR | 3696 | 27.000 |
| 35 | HCV-1b | 29 | 34 | 10 | A3 | SMMWSPPFLR | 3697 | 27.000 |
| 36 | HCV-1b | 36 | 56 | 9 | A3 | VLFDHPSFR | 3698 | 20.000 |
| 37 | HCV-1b | 36 | 45 | 10 | A3 | LLFLYLPLSF | 3699 | 20.000 |
| 38 | HCV-1b | 36 | 56 | 10 | A3 | VLFDHPSFRL | 3700 | 13.500 |
| 39 | HCV-1b | 43 | 37 | 9 | A3 | GLGPRGPTR | 3701 | 18.000 |
| 40 | HCV-1b | 43 | 16 | 10 | A3 | GLHEAGRADR | 3702 | 18.000 |
| 41 | HCV-1b | 47 | 16 | 9 | A3 | GLHDARERR | 3703 | 12.000 |
| 42 | HCV-1b | 1 | 32 | 10 | A0201 | VIWVRSSIPL | 3704 | 41.446 |
| 43 | HCV-1b | 1 | 20 | 10 | A0201 | LVGAPQTPGV | 3705 | 10.346 |
| 44 | HCV-1b | 6 | 84 | 9 | A0201 | LLWWGRPTV | 3706 | 981.379 |
| 45 | HCV-1b | 6 | 66 | 9 | A0201 | VLYPRRRCV | 3707 | 75.673 |
| 46 | HCV-1b | 6 | 8 | 9 | A0201 | SLLRCSTHT | 3708 | 27.527 |
| 47 | HCV-1b | 6 | 83 | 10 | A0201 | VLLWWGRPTV | 3709 | 437.482 |
| 48 | HCV-1b | 6 | 5 | 10 | A0201 | KLGSLLRCST | 3710 | 26.082 |
| 49 | HCV-1b | 6 | 66 | 10 | A0201 | VLYPRRRCVA | 3711 | 11.081 |
| 50 | HCV-1b | 7 | 7 | 9 | A0201 | FSWRTRASV | 3712 | 17.334 |
| 51 | HCV-1b | 18 | 53 | 9 | A0201 | LMPWTERWL | 3713 | 28.851 |
| 52 | HCV-1b | 18 | 29 | 9 | A0201 | SLGRHMLSM | 3714 | 11.426 |
| 53 | HCV-1b | 18 | 60 | 10 | A0201 | WLHRAEARFL | 3715 | 108.094 |
| 54 | HCV-1b | 18 | 29 | 10 | A0201 | SLGRHMLSMA | 3716 | 11.426 |
| 55 | HCV-1b | 13 | 4 | 10 | A0201 | FLPMVVALGA | 3717 | 22.853 |
| 56 | HCV-1b | 14 | 5 | 9 | A0201 | QLTRLQSWA | 3718 | 27.324 |
| 57 | HCV-1b | 14 | 53 | 9 | A0201 | LILERSPSM | 3719 | 17.616 |
| 58 | HCV-1b | 14 | 27 | 10 | A0201 | GLSCSPPLRL | 3720 | 21.362 |
| 59 | HCV-1b | 14 | 53 | 10 | A0201 | LILERSPSMA | 3721 | 17.616 |
| 60 | HCV-1b | 14 | 4 | 10 | A0201 | IQLTRLQSWA | 3722 | 17.426 |
| 61 | HCV-1b | 14 | 70 | 10 | A0201 | SGGEGISFSV | 3723 | 10.797 |
| 62 | HCV-1b | 14 | 93 | 10 | A0201 | QASESTLWRI | 3724 | 10.248 |
| 63 | HCV-1b | 19 | 3 | 10 | A0201 | QEWPARSWPL | 3725 | 25.857 |
| 64 | HCV-1b | 20 | 10 | 9 | A0201 | VLLRSSPAL | 3726 | 134.369 |
| 65 | HCV-1b | 23 | 22 | 10 | A0201 | ILGRCGGWPL | 3727 | 272.371 |
| 66 | HCV-1b | 29 | 34 | 9 | A0201 | SMMWSPPFL | 3728 | 313.968 |
| 67 | HCV-1b | 30 | 16 | 9 | A0201 | VLRSQFTNV | 3729 | 17.074 |
| 68 | HCV-1b | 31 | 30 | 9 | A0201 | KQLDTLQLT | 3730 | 92.267 |
| 69 | HCV-1b | 33 | 2 | 9 | A0201 | ALAHFHSIV | 3731 | 108.362 |
| 70 | HCV-1b | 33 | 11 | 10 | A0201 | TLQVRSIGWL | 3732 | 35.130 |
| 71 | HCV-1b | 36 | 47 | 9 | A0201 | FLYLPLSFA | 3733 | 925.081 |
| 72 | HCV-1b | 36 | 79 | 9 | A0201 | RLLQLKYCV | 3734 | 257.342 |
| 73 | HCV-1b | 36 | 44 | 9 | A0201 | RLLFLYLPL | 3735 | 118.561 |
| 74 | HCV-1b | 36 | 49 | 9 | A0201 | YLPLSFAVL | 3736 | 76.550 |
| 75 | HCV-1b | 36 | 47 | 10 | A0201 | FLYLPLSFAV | 3737 | 5938.072 |
| 76 | HCV-1b | 36 | 36 | 10 | A0201 | VLFDHPSFRL | 3738 | 3195.307 |
| 77 | HCV-1b | 40 | 6 | 10 | A0201 | ALAGFTTTSL | 3739 | 21.362 |
| 78 | HCV-1b | 43 | 11 | 10 | A0201 | SLCPNGLHEA | 3740 | 11.426 |
| 79 | HCV-1b | 45 | 30 | 9 | A0201 | LIPPGRTAV | 3741 | 16.258 |
| 80 | HCV-1b | 45 | 29 | 10 | A0201 | QLIPPGRTAV | 3742 | 69.552 |
| 81 | HCV-1b | 52 | 1 | 9 | A0201 | MLLEGLCSL | 3743 | 1267.104 |
| 82 | HCV-1b | 52 | 8 | 10 | A0201 | SLSSCEAPGL | 3744 | 21.362 |
| 83 | HCV-1b | 53 | 2 | 10 | A0201 | FLQCVGPRC | 3745 | 22.853 |
| 84 | HCV-1b | 18 | 48 | 10 | A1 | SGEPLRHSGR | 3746 | 22.500 |

TABLE 4c-continued 1b (1-3)

| No. Strain | ORF | Start | AA | HLA | Peptide sequence | SEQ ID NO: | Score |
|---|---|---|---|---|---|---|---|
| 85 HCV-1b | 48 | 3 | 9 | A1 | STDHRTCQK | 3747 | 25.000 |
| 86 HCV-1b | 48 | 3 | 10 | A1 | STDHRTCQKR | 3748 | 21.500 |
| 87 HCV-1b | 1 | 26 | 9 | B3501 | TPGVGRVIW | 3749 | 10.000 |
| 88 HCV-1b | 5 | 12 | 10 | B3501 | IPATYQVTAW | 3750 | 10.000 |
| 89 HCV-1b | 6 | 95 | 9 | B3501 | SPRIAGGRM | 3751 | 120.000 |
| 90 HCV-1b | 6 | 2 | 9 | B3501 | TPSKLGSLL | 3752 | 20.000 |
| 91 HCV-1b | 6 | 89 | 10 | B3501 | RPTVPESPRI | 3753 | 24.000 |
| 92 HCV-1b | 6 | 51 | 10 | B3501 | RTRGLIAGTM | 3754 | 12.000 |
| 93 HCV-1b | 6 | 94 | 10 | B3501 | ESPRIAGGRM | 3755 | 10.000 |
| 94 HCV-1b | 18 | 25 | 10 | B3501 | KAGWSLGRHM | 3756 | 12.000 |
| 95 HCV-1b | 18 | 28 | 10 | B3501 | WSLCRHMLSM | 3757 | 10.000 |
| 96 HCV-1b | 18 | 19 | 10 | B3501 | APPGTSKAGW | 3758 | 10.000 |
| 97 HCV-1b | 13 | 5 | 10 | B3501 | LPMVVALGAL | 3759 | 20.000 |
| 98 HCV-1b | 14 | 68 | 10 | B3501 | KPSGGEGISF | 3760 | 60.000 |
| 99 HCV-1b | 14 | 58 | 10 | B3501 | SPSMAKPSPL | 3761 | 20.000 |
| 100 HCV-1b | 14 | 46 | 10 | B3501 | TSRRWPCLIL | 3762 | 15.000 |
| 101 HCV-1b | 15 | 14 | 9 | B3501 | RPRLGCGPT | 3763 | 12.000 |
| 102 HCV-1b | 18 | 33 | 9 | B3501 | QPPNKRRLL | 3764 | 20.000 |
| 103 HCV-1b | 18 | 22 | 9 | B3501 | SSSRKRSGY | 3765 | 10.000 |
| 104 HCV-1b | 18 | 33 | 10 | B3501 | QPPNKRRLL | 3766 | 20.000 |
| 105 HCV-1b | 18 | 21 | 10 | B3501 | SSSSRKSGY | 3767 | 10.000 |
| 106 HCV-1b | 18 | 4 | 10 | B3501 | KSAPRTSLTL | 3768 | 10.000 |
| 107 HCV-1b | 20 | 13 | 9 | B3501 | RSSPALPSL | 3769 | 10.000 |
| 108 HCV-1b | 23 | 9 | 9 | B3501 | TPRAPAHPL | 3770 | 60.000 |
| 109 HCV-1b | 23 | 15 | 9 | B3501 | HPLQRQTIL | 3771 | 20.000 |
| 110 HCV-1b | 24 | 10 | 10 | B3501 | RPTSCGGRRW | 3772 | 20.000 |
| 111 HCV-1b | 24 | 23 | 10 | B3501 | SPAWSRRTRW | 3773 | 10.000 |
| 112 HCV-1b | 27 | 15 | 9 | B3501 | SPLTDCKSW | 3774 | 15.000 |
| 113 HCV-1b | 29 | 28 | 9 | B3501 | YARRWPSMM | 3775 | 18.000 |
| 114 HCV-1b | 29 | 20 | 9 | B3501 | YSQIWESVY | 3776 | 10.000 |
| 115 HCV-1b | 29 | 32 | 10 | B3501 | WSPMMWSPPF | 3777 | 20.000 |
| 116 HCV-1b | 29 | 15 | 10 | B3501 | QPALSYSQIW | 3778 | 10.000 |
| 117 HCV-1b | 30 | 9 | 9 | B3501 | RSPRTTSVL | 3779 | 10.000 |
| 118 HCV-1b | 31 | 19 | 9 | B3501 | IPPPPSHGL | 3780 | 20.000 |
| 119 HCV-1b | 33 | 46 | 9 | B3501 | CPRGGGPPL | 3781 | 60.000 |
| 120 HCV-1b | 33 | 37 | 9 | B3501 | GPGASALGY | 3782 | 40.000 |
| 121 HCV-1b | 33 | 46 | 10 | B3501 | CPRGGGPPLV | 3783 | 12.000 |
| 122 HCV-1b | 36 | 50 | 9 | B3501 | LPLSFAVLF | 3784 | 20.000 |
| 123 HCV-1b | 36 | 41 | 9 | B3501 | ESARLLFLY | 3785 | 10.000 |
| 124 HCV-1b | 36 | 28 | 10 | B3501 | RPGSGGRREL | 3786 | 40.000 |
| 125 HCV-1b | 36 | 74 | 10 | B3501 | IPCHERLLQL | 3787 | 20.000 |
| 126 HCV-1b | 39 | 10 | 10 | B3501 | SPGGRARLCL | 3788 | 20.000 |
| 127 HCV-1b | 39 | 8 | 10 | B3501 | LPSPGGRARL | 3789 | 20.000 |
| 128 HCV-1b | 43 | 30 | 9 | B3501 | QPSYPATGL | 3790 | 20.000 |
| 129 HCV-1b | 43 | 3 | 10 | B3501 | VSAEGRWGSL | 3791 | 10.000 |
| 130 HCV-1b | 45 | 46 | 9 | B3501 | RSHWQRQEY | 3792 | 20.000 |
| 131 HCV-1b | 45 | 12 | 9 | B3501 | CARRVHGNY | 3793 | 18.000 |
| 132 HCV-1b | 45 | 2 | 10 | B3501 | HPGGCEGGGL | 3794 | 30.000 |
| 133 HCV-1b | 45 | 12 | 10 | B3501 | CARRVHGNYY | 3795 | 18.000 |
| 134 HCV-1b | 53 | 8 | 10 | B3501 | RPRCIRQKGV | 3796 | 24.000 |
| 135 HCV-1b | 54 | 1 | 10 | B3501 | MPQETWGTTL | 3797 | 40.000 |
| 136 HCV-1b | 8 | 51 | 10 | B4403 | HELMPWTERW | 3798 | 36.000 |
| 137 HCV-1b | 19 | 1 | 10 | B4403 | MEQEWPARSW | 3799 | 18.000 |
| 138 HCV-1b | 29 | 24 | 9 | B4403 | WESVYARRW | 3800 | 18.000 |
| 139 HCV-1b | 36 | 77 | 9 | B4403 | HERLLQLKY | 3801 | 180.000 |
| 140 HCV-1b | 36 | 40 | 10 | B4403 | RESARLLFLY | 3802 | 270.000 |
| 141 HCV-1b | 43 | 18 | 10 | B4403 | HEAGRADRHV | 3803 | 18.000 |
| 142 HCV-1b | 47 | 5 | 9 | B4403 | VEVSHTAET | 3804 | 12.000 |
| 143 HCV-1b | 47 | 5 | 10 | B4403 | VEVSHTAETY | 3805 | 360.000 |
| 144 HCV-1b | 47 | 11 | 10 | B4403 | AETYAARANT | 3806 | 12.000 |
| 145 HCV-1b | 52 | 21 | 9 | B4403 | RERRRPCRY | 3807 | 120.000 |
| 146 HCV-1b | 52 | 12 | 9 | B4403 | CEAPGLHDA | 3808 | 24.000 |
| 147 HCV-1b | 1 | 45 | 10 | B7 | SPTSWGTFRL | 3809 | 80.000 |
| 148 HCV-1b | 1 | 23 | 10 | B7 | APQTPGVGRV | 3810 | 12.000 |
| 149 HCV-1b | 5 | 14 | 9 | B7 | ATYQVTAWL | 3811 | 12.000 |
| 150 HCV-1b | 6 | 95 | 9 | B7 | SPRIAGGRM | 3812 | 200.000 |
| 151 HCV-1b | 6 | 2 | 9 | B7 | TPSKLGSLL | 3813 | 80.000 |
| 152 HCV-1b | 6 | 36 | 9 | B7 | SLRGGVPSL | 3814 | 40.000 |
| 153 HCV-1b | 6 | 29 | 9 | B7 | AAAPSTSSL | 3815 | 36.000 |
| 154 HCV-1b | 6 | 40 | 9 | B7 | GVPSLTLCL | 3816 | 20.000 |
| 155 HCV-1b | 6 | 68 | 10 | B7 | YPRRCVAQC | 3817 | 20.000 |
| 156 HCV-1b | 6 | 58 | 10 | B7 | GMTHPNRAVL | 3818 | 18.000 |
| 157 HCV-1b | 6 | 75 | 10 | B7 | AQCIASPRVL | 3819 | 12.000 |
| 158 HCV-1b | 6 | 51 | 10 | B7 | RTRGLIAGTM | 3820 | 10.000 |
| 159 HCV-1b | 8 | 39 | 10 | B7 | YGRCSCSCWL | 3821 | 40.000 |

TABLE 4c-continued 1b (1-3)

| No. Strain | ORF | Start | AA | HLA | Peptide sequence | SEQ ID NO: | Score |
|---|---|---|---|---|---|---|---|
| 160 HCV-1b | 8 | 26 | 10 | B7 | AGWSLGRHML | 3822 | 18.000 |
| 161 HCV-1b | 8 | 52 | 10 | B7 | ELMPWTERWL | 3823 | 12.000 |
| 162 HCV-1b | 9 | 4 | 9 | B7 | EAAMPSSSL | 3824 | 18.000 |
| 163 HCV-1b | 13 | 5 | 10 | B7 | LPMVVALGAL | 3825 | 240.000 |
| 164 HCV-1b | 13 | 2 | 10 | B7 | ASFLPMVVAL | 3826 | 12.000 |
| 165 HCV-1b | 14 | 105 | 9 | B7 | GSMCPSYQL | 3827 | 18.000 |
| 166 HCV-1b | 14 | 58 | 10 | B7 | SPSMAKPSPL | 3828 | 80.000 |
| 167 HCV-1b | 14 | 46 | 10 | B7 | TSRRWPCLIL | 3829 | 60.000 |
| 168 HCV-1b | 14 | 15 | 10 | B7 | AQSWTKRRRL | 3830 | 18.000 |
| 169 HCV-1b | 15 | 14 | 9 | B7 | RPRLGCGPT | 3831 | 20.000 |
| 170 HCV-1b | 16 | 5 | 9 | B7 | CPRPSRQET | 3832 | 30.000 |
| 171 HCV-1b | 16 | 5 | 10 | B7 | CPRPSRQETT | 3833 | 20.000 |
| 172 HCV-1b | 18 | 33 | 9 | B7 | QPPNKRRLL | 3834 | 120.000 |
| 173 HCV-1b | 18 | 6 | 9 | B7 | APRTSLTLS | 3835 | 12.000 |
| 174 HCV-1b | 18 | 34 | 9 | B7 | PPNKRRLLL | 3836 | 12.000 |
| 175 HCV-1b | 18 | 5 | 9 | B7 | SAPRTSLTL | 3837 | 12.000 |
| 176 HCV-1b | 18 | 33 | 10 | B7 | QPPNKRRLLL | 3838 | 120.000 |
| 177 HCV-1b | 20 | 4 | 9 | B7 | RATPQRVLL | 3839 | 18.000 |
| 178 HCV-1b | 20 | 2 | 10 | B7 | CLRATPQRVL | 3840 | 60.000 |
| 179 HCV-1b | 20 | 9 | 10 | B7 | RVLLRSSPAL | 3841 | 20.000 |
| 180 HCV-1b | 23 | 9 | 9 | B7 | TPRAPAHPL | 3842 | 1200.000 |
| 181 HCV-1b | 23 | 15 | 9 | B7 | HLPQRQTIL | 3843 | 80.000 |
| 182 HCV-1b | 23 | 23 | 9 | B7 | LGRCGGWPL | 3844 | 40.000 |
| 183 HCV-1b | 25 | 24 | 9 | B7 | SGRARITTL | 3845 | 40.000 |
| 184 HCV-1b | 25 | 14 | 9 | B7 | NPRSSPQRC | 3846 | 20.000 |
| 185 HCV-1b | 25 | 9 | 9 | B7 | ACGRRRSPL | 3847 | 18.000 |
| 186 HCV-1b | 25 | 8 | 10 | B7 | QACGRRRSPL | 3848 | 18.000 |
| 187 HCV-1b | 28 | 20 | 9 | B7 | CGRTCWKTL | 3849 | 40.000 |
| 188 HCV-1b | 29 | 28 | 9 | B7 | YARRWPSMM | 3850 | 30.000 |
| 189 HCV-1b | 29 | 34 | 9 | B7 | SMMWSPPFL | 3851 | 12.000 |
| 190 HCV-1b | 31 | 19 | 9 | B7 | IPPPPSHGL | 3852 | 120.000 |
| 191 HCV-1b | 31 | 26 | 10 | B7 | GLGRKQLDTL | 3853 | 40.000 |
| 192 HCV-1b | 33 | 46 | 9 | B7 | CPRGGGPPL | 3854 | 800.000 |
| 193 HCV-1b | 33 | 46 | 10 | B7 | CPRGGGPPLV | 3855 | 40.000 |
| 194 HCV-1b | 33 | 3 | 10 | B7 | LAHFHSIVTL | 3856 | 12.000 |
| 195 HCV-1b | 36 | 42 | 9 | B7 | SARLLFLYL | 3857 | 120.000 |
| 196 HCV-1b | 36 | 38 | 9 | B7 | CNRESARLL | 3858 | 40.000 |
| 197 HCV-1b | 36 | 28 | 10 | B7 | RPGSGGRREL | 3859 | 120.000 |
| 198 HCV-1b | 36 | 74 | 10 | B7 | IPCHERLLQL | 3860 | 80.000 |
| 199 HCV-1b | 39 | 12 | 9 | B7 | GGRARLCLL | 3861 | 40.000 |
| 200 HCV-1b | 39 | 10 | 10 | B7 | SPGGRARLCL | 3862 | 120.000 |
| 201 HCV-1b | 39 | 8 | 10 | B7 | LPSPGGRARL | 3863 | 120.000 |
| 202 HCV-1b | 40 | 30 | 9 | B7 | FCRSGTLDL | 3864 | 40.000 |
| 203 HCV-1b | 40 | 7 | 9 | B7 | LAGFTTTSL | 3865 | 12.000 |
| 204 HCV-1b | 40 | 6 | 10 | B7 | ALAGFTTTSL | 3866 | 12.000 |
| 205 HCV-1b | 43 | 30 | 9 | B7 | QPSYPATGL | 3867 | 120.000 |
| 206 HCV-1b | 43 | 39 | 9 | B7 | GPRGPTRFC | 3868 | 30.000 |
| 207 HCV-1b | 43 | 20 | 10 | B7 | AGRADRHVHL | 3869 | 120.000 |
| 208 HCV-1b | 45 | 22 | 9 | B7 | AVSGLHGQL | 3870 | 60.000 |
| 209 HCV-1b | 45 | 2 | 10 | B7 | HPGGCEGGGL | 3871 | 80.000 |
| 210 HCV-1b | 45 | 21 | 10 | B7 | YAVSGLHGQL | 3872 | 12.000 |
| 211 HCV-1b | 46 | 5 | 10 | B7 | DSRLQGSHL | 3873 | 40.000 |
| 212 HCV-1b | 47 | 15 | 9 | B7 | AARANTLAV | 3874 | 18.000 |
| 213 HCV-1b | 49 | 9 | 9 | B7 | SAHFHAHRPL | 3875 | 12.000 |
| 214 HCV-1b | 51 | 16 | 9 | B7 | AAHQRVEQL | 3876 | 36.000 |
| 215 HCV-1b | 51 | 15 | 10 | B7 | QAAHQRVEQL | 3877 | 12.000 |
| 216 HCV-1b | 53 | 8 | 10 | B7 | RPRCIRQKGV | 3878 | 40.000 |
| 217 HCV-1b | 54 | 1 | 10 | B7 | MPQETWGTTL | 3879 | 80.000 |
| 218 HCV-1b | 56 | 3 | 9 | B7 | VVQPPGPPL | 3880 | 30.000 |
| 219 HCV-1b | 56 | 2 | 10 | B7 | SVVQPPGPPL | 3881 | 30.000 |
| 220 HCV-1b | 6 | 46 | 10 | B8 | LCLTSRTRGL | 3882 | 16.000 |
| 221 HCV-1b | 14 | 85 | 10 | B8 | SPSMAKPSPL | 3883 | 16.000 |
| 222 HCV-1b | 18 | 33 | 9 | B8 | QPPNKRRLL | 3884 | 16.000 |
| 223 HCV-1b | 18 | 33 | 10 | B8 | QPPNKRRLLL | 3885 | 16.000 |
| 224 HCV-1b | 23 | 15 | 9 | B8 | HPLQRQTIL | 3886 | 16.000 |
| 225 HCV-1b | 23 | 9 | 9 | B8 | TPRAPAHPL | 3887 | 16.000 |
| 226 HCV-1b | 25 | 24 | 9 | B8 | SGRARITTL | 3888 | 16.000 |
| 227 HCV-1b | 27 | 9 | 9 | B8 | ACGRRRSPL | 3889 | 16.000 |
| 228 HCV-1b | 27 | 8 | 10 | B8 | QACGRRRSPL | 3890 | 16.000 |
| 229 HCV-1b | 33 | 46 | 9 | B8 | CPRGGGPPL | 3891 | 16.000 |
| 230 HCV-1b | 36 | 42 | 9 | B8 | SARLLFLYL | 3892 | 16.000 |
| 231 HCV-1b | 36 | 74 | 10 | B8 | IPCHERLLQL | 3893 | 16.000 |
| 232 HCV-1b | 39 | 12 | 9 | B8 | GGRARLCLL | 3894 | 16.000 |
| 233 HCV-1b | 40 | 30 | 9 | B8 | FCRSGTLDL | 3895 | 16.000 |
| 234 HCV-1b | 43 | 20 | 10 | B8 | AGRADRHVHL | 3896 | 16.000 |

TABLE 4c-continued 1b (1-3)

| No. | Strain | ORF | Start | AA | HLA | Peptide sequence | SEQ ID NO: | Score |
|---|---|---|---|---|---|---|---|---|
| 235 | HCV-1b | 51 | 16 | 9 | B8 | AAHQRVEQL | 3897 | 16.000 |
| 236 | HCV-1b | 51 | 15 | 10 | B8 | QAAHQRVEQL | 3898 | 16.000 |
| 237 | HCV-1b | 52 | 19 | 9 | B8 | DARERRRPC | 3899 | 48.000 |
| 238 | HCV-1b | 53 | 8 | 10 | B8 | RPRCIRQKGV | 3900 | 24.000 |

TABLE 4d 1b (4-6)

| No. | Strain | ORF | Start | AA | HLA | Peptide sequence | SEQ ID NO: | Score |
|---|---|---|---|---|---|---|---|---|
| 1 | HCV 1b | 1 | 2 | 10 | B7 | ICREaSISTL | 3901 | 40.000 |
| 2 | HCV 1b | 1 | 2 | 10 | B8 | ICREaSISTL | 3902 | 24.000 |
| 3 | HCV 1b | 1 | 4 | 9 | B_4403 | REASISTLC | 3903 | 12.000 |
| 4 | HCV 1b | 1 | 4 | 10 | B_4403 | REASiSTLCS | 3904 | 12.000 |
| 5 | HCV 1b | 2 | 20 | 9 | A_0201 | CLPLQKVGV | 3905 | 69.552 |
| 6 | HCV 1b | 2 | 4 | 9 | B_3501 | WPGVFSSPF | 3906 | 20.000 |
| 7 | HCV 1b | 3 | 12 | 9 | A_0201 | MMLSAPSRI | 3907 | 47.394 |
| 8 | HCV 1b | 3 | 13 | 10 | A_0201 | MLSApSRILV | 3908 | 118.238 |
| 9 | HCV 1b | 3 | 11 | 10 | A_0201 | NMMLsAPSRI | 3909 | 27.879 |
| 10 | HCV 1b | 3 | 5 | 9 | B7 | RPTHWRNMM | 3910 | 30.000 |
| 11 | HCV 1b | 3 | 5 | 10 | B7 | RPTHwRNMML | 3911 | 80.000 |
| 12 | HCV 1b | 3 | 3 | 10 | B7 | RGRPtHWRNM | 3912 | 10.000 |
| 13 | HCV 1b | 3 | 5 | 9 | B_3501 | RPTHWRNMM | 3913 | 80.000 |
| 14 | HCV 1b | 3 | 5 | 10 | B_3501 | RPTHwRNMML | 3914 | 40.000 |
| 15 | HCV 1b | 3 | 3 | 10 | B_3501 | RGRPtHWRNM | 3915 | 12.000 |
| 16 | HCV 1b | 4 | 18 | 10 | A_0201 | RLAAqESTGI | 3916 | 10.433 |
| 17 | HCV 1b | 4 | 12 | 9 | A24 | RYSPGTRLA | 3917 | 12.000 |
| 18 | HCV 1b | 4 | 44 | 10 | A24 | RGPSsRIHGL | 3918 | 12.000 |
| 19 | HCV 1b | 4 | 12 | 10 | A24 | RYSPgTRLAA | 3919 | 12.000 |
| 20 | HCV 1b | 4 | 45 | 9 | B7 | GPSSRIHGL | 3920 | 80.000 |
| 21 | HCV 1b | 4 | 10 | 10 | B7 | ISRYsPGTRL | 3921 | 60.000 |
| 22 | HCV 1b | 4 | 47 | 10 | B7 | SSRIhGLPDL | 3922 | 40.000 |
| 23 | HCV 1b | 4 | 45 | 9 | B7 | GPSSRIHGL | 3923 | 16.000 |
| 24 | HCV 1b | 4 | 45 | 9 | B_3501 | GPSSRIHGL | 3924 | 20.000 |
| 25 | HCV 1b | 4 | 31 | 9 | B_3501 | SPSRPEEGW | 3925 | 10.000 |
| 26 | HCV 1b | 4 | 10 | 10 | B_3501 | ISRYsPGTRL | 3926 | 15.000 |
| 27 | HCV 1b | 4 | 47 | 10 | B_3501 | SSRIhGLPDL | 3927 | 15.000 |
| 28 | HCV 1b | 4 | 20 | 10 | B_3501 | AAQEsTGIRM | 3928 | 12.000 |
| 29 | HCV 1b | 5 | | | | no hits | | |
| 30 | HCV 1b | 6 | | | | no hits | | |
| 31 | HCV 1b | 7 | | | | no hits | | |
| 32 | HCV 1b | 8 | | | | no hits | | |
| 33 | HCV 1b | 9 | | | | no hits | | |
| 34 | HCV 1b | 10 | | | | no hits | | |
| 35 | HCV 1b | 11 | | | | no hits | | |
| 36 | HCV 1b | 12 | 12 | 10 | A_0201 | AEWIsLLSTV | 3929 | 25.817 |
| 37 | HCV 1b | 12 | 3 | 10 | A_0201 | SMMLLRGSQA | 3930 | 13.276 |
| 38 | HCV 1b | 12 | 12 | 10 | B_4403 | AEWIsLLSTV | 3931 | 18.000 |
| 39 | HCV 1b | 13 | 14 | 9 | A_0201 | QQPPLVWWL | 3932 | 205.491 |
| 40 | HCV 1b | 13 | 21 | 9 | A_0201 | WLFAVTRAL | 3933 | 72.718 |
| 41 | HCV 1b | 13 | 17 | 9 | A_0201 | PLVWWLFAV | 3934 | 20.412 |
| 42 | HCV 1b | 13 | 13 | 10 | A_0201 | EQQPpLVWWL | 3935 | 15.412 |
| 43 | HCV 1b | 13 | 4 | 9 | A3 | GLATWTPPR | 3936 | 36.000 |
| 44 | HCV 1b | 13 | 10 | 9 | B7 | PPREQQPPL | 3937 | 80.000 |
| 45 | HCV 1b | 13 | 9 | 10 | B7 | TPPReQQPPL | 3938 | 80.000 |
| 46 | HCV 1b | 13 | 15 | 9 | B_3501 | QPPLVWWLF | 3939 | 20.000 |
| 47 | HCV 1b | 13 | 10 | 9 | B_3501 | PPREQQPPL | 3940 | 12.000 |
| 48 | HCV 1b | 13 | 9 | 10 | B_3501 | TPPReQQPPL | 3941 | 20.000 |
| 49 | HCV 1b | 13 | 12 | 10 | B_4403 | REQQpPLVWW | 3942 | 18.000 |
| 50 | HCV 1b | 14 | 15 | 10 | A_0201 | GMLPgRGSCLL | 3943 | 57.085 |
| 51 | HCV 1b | 14 | 16 | 10 | A_0201 | MLPGrGSCLL | 3944 | 36.316 |
| 52 | HCV 1b | 14 | 23 | 9 | A_0201 | CLLPAWSGT | 3945 | 46.873 |
| 53 | HCV 1b | 14 | 16 | 9 | A_0201 | MLPGRGSCL | 3946 | 36.316 |
| 54 | HCV 1b | 14 | 17 | 9 | B7 | LPGRGSCLL | 3947 | 80.000 |
| 55 | HCV 1b | 14 | 7 | 10 | B7 | EPWRtPWLGM | 3948 | 30.000 |
| 56 | HCV 1b | 14 | 5 | 10 | B7 | GPEPwRTPWL | 3949 | 24.000 |
| 57 | HCV 1b | 14 | 7 | 10 | B_3501 | EPWRtPWLGM | 3950 | 40.000 |
| 58 | HCV 1b | 14 | 17 | 9 | B_3501 | LPGRGSCLL | 3951 | 20.000 |
| 59 | HCV 1b | 14 | 2 | 10 | B_4403 | MEVGpEPWRT | 3952 | 12.000 |
| 60 | HCV 1b | 14 | 19 | 9 | A_0201 | RLLPRQRRL | 3953 | 15.808 |
| 61 | HCV 1b | 14 | 12 | 9 | A24 | PYSPSSERL | 3954 | 24.000 |

TABLE 4d-continued 1b (4-6)

| No. | Strain | ORF | Start | AA | HLA | Peptide sequence | SEQ ID NO: | Score |
|---|---|---|---|---|---|---|---|---|
| 62 | HCV 1b | 14 | 19 | 9 | A24 | RLLPRQRRL | 3955 | 14.400 |
| 63 | HCV 1b | 14 | 12 | 10 | A24 | PYSPsSERLL | 3956 | 24.000 |
| 64 | HCV 1b | 14 | 11 | 10 | B7 | RPYSpSSERL | 3957 | 80.000 |
| 65 | HCV 1b | 14 | 5 | 9 | B_3501 | RSLSQSRPY | 3958 | 20.000 |
| 66 | HCV 1b | 14 | 11 | 10 | B_3501 | RPYSpSSERL | 3959 | 40.000 |
| 67 | HCV 1b | 15 | 19 | 9 | A_0201 | RLLPRQRRL | 3960 | 15.808 |
| 68 | HCV 1b | 15 | 12 | 9 | A24 | PYSPSSERL | 3961 | 24.000 |
| 69 | HCV 1b | 15 | 19 | 9 | A24 | RLLPRQRRL | 3962 | 14.400 |
| 70 | HCV 1b | 15 | 12 | 10 | A24 | PYSPsSERLL | 3963 | 24.000 |
| 71 | HCV 1b | 15 | 11 | 10 | B7 | RPYSpSSERL | 3964 | 80.000 |
| 72 | HCV 1b | 15 | 5 | 9 | B_3501 | RSLSQSRPY | 3965 | 20.000 |
| 73 | HCV 1b | 15 | 11 | 10 | B_3501 | RPYSpSSERL | 3966 | 40.000 |
| 74 | HCV 1b | 16 | 3 | 9 | B7 | AVRPGGMSC | 3967 | 15.000 |
| 75 | HCV 1b | 17 | | 7 | | no hits | | |
| 76 | HCV 1b | 18 | 21 | 10 | A_0201 | SLGPwHKLVV | 3968 | 28.516 |
| 77 | HCV 1b | 18 | 27 | 10 | A_0201 | KLVVvKPARA | 3969 | 17.388 |
| 78 | HCV 1b | 18 | 6 | 10 | A24 | RVPDlQKPRL | 3970 | 14.400 |
| 79 | HCV 1b | 18 | 27 | 9 | A3 | KLVVVKPAR | 3971 | 27.000 |
| 80 | HCV 1b | 18 | 47 | 9 | B7 | MPPQGPACL | 3972 | 80.000 |
| 81 | HCV 1b | 18 | 14 | 9 | B7 | RLRTMQPSL | 3973 | 40.000 |
| 82 | HCV 1b | 18 | 2 | 9 | B7 | VTRSRVPDL | 3974 | 40.000 |
| 83 | HCV 1b | 18 | 7 | 9 | B7 | VPDLQKPRL | 3975 | 24.000 |
| 84 | HCV 1b | 18 | 19 | 10 | B7 | QPSLgPWHKL | 3976 | 120.000 |
| 85 | HCV 1b | 18 | 1 | 10 | B7 | MVTRsRVPDL | 3977 | 20.000 |
| 86 | HCV 1b | 18 | 6 | 10 | B7 | RVPDlQKPRL | 3978 | 20.000 |
| 87 | HCV 1b | 18 | 2 | 9 | B8 | VTRSRVPDL | 3979 | 80.000 |
| 88 | HCV 1b | 18 | 19 | 10 | B_3501 | QPSLgPWHKL | 3980 | 20.000 |
| 89 | HCV 1b | 18 | 32 | 10 | B_3501 | KPARaGATAI | 3981 | 16.000 |
| 90 | HCV 1b | 18 | 12 | 10 | B_3501 | KPRLrTMQPS | 3982 | 12.000 |
| 91 | HCV 1b | 19 | | 7 | | no hits | | |
| 92 | HCV 1b | 20 | 7 | 10 | B7 | RTRGsGCWRL | 3983 | 40.000 |
| 93 | HCV 1b | 20 | 24 | 9 | B8 | CARQRQQRV | 3984 | 48.000 |
| 94 | HCV 1b | 21 | 8 | 9 | A1 | VLEAARHSY | 3985 | 45.000 |
| 95 | HCV 1b | 21 | 2 | 10 | A_0201 | ALPGgGVLEA | 3986 | 11.426 |
| 96 | HCV 1b | 21 | 1 | 9 | B7 | MALPGGGVL | 3987 | 12.000 |
| 97 | HCV 1b | 22 | 14 | 10 | B7 | NQRGrARDRL | 3988 | 60.000 |
| 98 | HCV 1b | 23 | 3 | 10 | A_0201 | MLPSqELTGV | 3989 | 271.948 |
| 99 | HCV 1b | 23 | 1 | 9 | A_0201 | MIMLPSQEL | 3990 | 18.476 |
| 100 | HCV 1b | 23 | 2 | 9 | A_0201 | IMLPSQELT | 3991 | 16.588 |
| 101 | HCV 1b | 23 | 1 | 9 | B7 | MIMLPSQEL | 3992 | 18.000 |
| 102 | HCV 1b | 23 | 7 | 10 | B_4403 | QELTgVCLAV | 3993 | 12.000 |
| 103 | HCV 1b | 23 | 7 | 9 | B_4403 | QELTGVCLA | 3994 | 24.000 |
| 104 | HCV 1b | 24 | | 7 | | no hits | | |
| 105 | HCV 1b | 25 | 6 | 10 | A1 | TVESkQRVSY | 3995 | 90.000 |
| 106 | HCV 1b | 25 | 19 | 9 | A_0201 | MGFFFDFQV | 3996 | 62.942 |
| 107 | HCV 1b | 25 | 18 | 10 | A_0201 | PMGFfFDFQV | 3997 | 24.356 |
| 108 | HCV 1b | 25 | 14 | 9 | A24 | SYEKPMGFF | 3998 | 150.000 |
| 109 | HCV 1b | 25 | 20 | 9 | A24 | GFFFDFQVF | 3999 | 14.400 |
| 110 | HCV 1b | 25 | 14 | 10 | A24 | SYEKpMGFFF | 4000 | 150.000 |
| 111 | HCV 1b | 25 | 38 | 10 | A24 | EYWNpYEEPI | 4001 | 50.000 |
| 112 | HCV 1b | 25 | 10 | 10 | B7 | KQRVsYEKPM | 4002 | 10.000 |
| 113 | HCV 1b | 25 | 10 | 10 | B_3501 | KQRVsYEKPM | 4003 | 12.000 |
| 114 | HCV 1b | 25 | 13 | 10 | B_3501 | VSYEkPMGFF | 4004 | 10.000 |
| 115 | HCV 1b | 25 | 25 | 9 | B_3501 | CPGEYWNPY | 4005 | 80.000 |
| 116 | HCV 1b | 25 | 17 | 9 | B_3501 | KPMGFFFDF | 4006 | 40.000 |
| 117 | HCV 1b | 25 | 13 | 9 | B_3501 | VSYEKPMGF | 4007 | 10.000 |
| 118 | HCV 1b | 25 | 31 | 9 | B_3501 | NSTRCPGEY | 4008 | 10.000 |
| 119 | HCV 1b | 25 | 15 | 9 | B_4403 | YEKPMGFFF | 4009 | 120.000 |
| 120 | HCV 1b | 25 | 7 | 9 | B_4403 | VESKQRVSY | 4010 | 120.000 |
| 121 | HCV 1b | 26 | 17 | 9 | A1 | HTEWMWLTA | 4011 | 11.250 |
| 122 | HCV 1b | 26 | 1 | 10 | A_0201 | MMVVsIGVTV | 4012 | 85.394 |
| 123 | HCV 1b | 26 | 26 | 10 | A_0201 | LLDRfRTSFA | 4013 | 18.580 |
| 124 | HCV 1b | 26 | 14 | 10 | A_0201 | KSFHtEWMWL | 4014 | 16.885 |
| 125 | HCV 1b | 26 | 2 | 9 | A_0201 | MVVSIGVTV | 4015 | 10.346 |
| 126 | HCV 1b | 26 | 15 | 9 | A24 | SFHTEWMWL | 4016 | 20.000 |
| 127 | HCV 1b | 26 | 20 | 10 | A3 | WMWLtALLDR | 4017 | 60.000 |
| 128 | HCV 1b | 26 | 12 | 10 | B_3501 | SSKSfHTEWM | 4018 | 30.000 |
| 129 | HCV 1b | 26 | 14 | 10 | B_3501 | KSFHtEWMWL | 4019 | 15.000 |
| 130 | HCV 1b | 27 | 16 | 10 | A_0201 | SLLSsAAHGV | 4020 | 257.342 |
| 131 | HCV 1b | 27 | 1 | 10 | A_0201 | MLWWrSKELL | 4021 | 147.697 |
| 132 | HCV 1b | 27 | 12 | 10 | A_0201 | ALMGsLLSSA | 4022 | 42.278 |
| 133 | HCV 1b | 27 | 9 | 10 | A_0201 | LLNAlMGSLL | 4023 | 36.316 |
| 134 | HCV 1b | 27 | 5 | 9 | A24 | RSKELLNAL | 4024 | 13.824 |
| 135 | HCV 1b | 27 | 5 | 9 | B_3501 | RSKELLNAL | 4025 | 60.000 |
| 136 | HCV 1b | 27 | 5 | 10 | B_3501 | RSKElLNALM | 4026 | 120.000 |

TABLE 4d-continued 1b (4-6)

| No. | Strain | ORF | Start | AA | HLA | Peptide sequence | SEQ ID NO: | Score |
|---|---|---|---|---|---|---|---|---|
| 137 | HCV 1b | 27 | 7 | 10 | B_4403 | KELLnALMGS | 4027 | 18.000 |
| 138 | HCV 1b | 28 | 29 | 9 | A1 | TADDSELPK | 4028 | 50.000 |
| 139 | HCV 1b | 28 | 7 | 9 | A1 | TSDPLSPSS | 4029 | 15.000 |
| 140 | HCV 1b | 28 | 3 | 9 | A24 | EYDSTSDPL | 4030 | 200.000 |
| 141 | HCV 1b | 28 | 61 | 9 | A24 | RGGGIGGAL | 4031 | 11.200 |
| 142 | HCV 1b | 28 | 52 | 9 | B7 | SVRTTVLFL | 4032 | 200.000 |
| 143 | HCV 1b | 28 | 19 | 9 | B7 | SGRAVAVPL | 4033 | 40.000 |
| 144 | HCV 1b | 28 | 9 | 10 | B_3501 | DPLSpSSEAW | 4034 | 10.000 |
| 145 | HCV 1b | 28 | 33 | 10 | B_4403 | SELPkVLVAS | 4035 | 72.000 |
| 146 | HCV 1b | 28 | 15 | 10 | B_4403 | SEAWsGRAVA | 4036 | 16.000 |
| 147 | HCV 1b | 28 | 33 | 9 | B_4403 | SELPKVLVA | 4037 | 144.000 |
| 148 | HCV 1b | 28 | 15 | 9 | B_4403 | SEAWSGRAV | 4038 | 16.000 |
| 149 | HCV 1b | 29 | 40 | 9 | A1 | FSDSTRVMF | 4039 | 15.000 |
| 150 | HCV 1b | 29 | 92 | 9 | A1 | GGDPLANLR | 4040 | 12.500 |
| 151 | HCV 1b | 29 | 128 | 9 | A1 | SCDPTRYWL | 4041 | 10.000 |
| 152 | HCV 1b | 29 | 62 | 10 | A_0201 | RSASgETWWV | 4042 | 18.728 |
| 153 | HCV 1b | 29 | 38 | 9 | A_0201 | TLFSDSTRV | 4043 | 257.342 |
| 154 | HCV 1b | 29 | 106 | 9 | A_0201 | VMWEGSVSM | 4044 | 207.569 |
| 155 | HCV 1b | 29 | 63 | 9 | A_0201 | SASGETWWV | 4045 | 39.848 |
| 156 | HCV 1b | 29 | 177 | 9 | A_0201 | FTLSVVMPV | 4046 | 37.815 |
| 157 | HCV 1b | 29 | 155 | 9 | A_0201 | YLCNRTPST | 4047 | 34.279 |
| 158 | HCV 1b | 29 | 135 | 9 | A_0201 | WLSPTWNVT | 4048 | 23.893 |
| 159 | HCV 1b | 29 | 171 | 9 | A_0201 | GTWHGHFTL | 4049 | 14.283 |
| 160 | HCV 1b | 29 | 98 | 9 | A_0201 | NLRLAVSAV | 4050 | 12.158 |
| 161 | HCV 1b | 29 | 148 | 9 | A24 | RGLHAGAYL | 4051 | 12.000 |
| 162 | HCV 1b | 29 | 133 | 9 | A24 | RYWLSPTWN | 4052 | 10.000 |
| 163 | HCV 1b | 29 | 75 | 10 | A24 | AFKEgADNWL | 4053 | 28.800 |
| 164 | HCV 1b | 29 | 39 | 10 | A24 | LFSDsTRVMF | 4054 | 12.000 |
| 165 | HCV 1b | 29 | 133 | 10 | A24 | RYWLsPTWNV | 4055 | 10.000 |
| 166 | HCV 1b | 29 | 46 | 9 | A3 | VMFPPISCR | 4056 | 67.500 |
| 167 | HCV 1b | 29 | 88 | 9 | B7 | LAKEGGDPL | 4057 | 12.000 |
| 168 | HCV 1b | 29 | 105 | 10 | B7 | AVMWeGSVSM | 4058 | 45.000 |
| 169 | HCV 1b | 29 | 141 | 10 | B7 | NVTSsRRRGL | 4059 | 30.000 |
| 170 | HCV 1b | 29 | 170 | 10 | B7 | AGTWhGHFTL | 4060 | 12.000 |
| 171 | HCV 1b | 29 | 52 | 10 | B7 | SCRHrRLASM | 4061 | 10.000 |
| 172 | HCV 1b | 29 | 98 | 10 | B7 | NLRLaVSAVM | 4062 | 10.000 |
| 173 | HCV 1b | 29 | 30 | 10 | B8 | GSKEsRTTTL | 4063 | 120.000 |
| 174 | HCV 1b | 29 | 52 | 10 | B8 | SCRHrRLASM | 4064 | 80.000 |
| 175 | HCV 1b | 29 | 88 | 9 | B8 | LAKEGGDPL | 4065 | 24.000 |
| 176 | HCV 1b | 29 | 88 | 9 | B_3501 | LAKEGGDPL | 4066 | 18.000 |
| 177 | HCV 1b | 29 | 30 | 10 | B_3501 | GSKEsRTTTL | 4067 | 30.000 |
| 178 | HCV 1b | 29 | 127 | 10 | B_3501 | GSCDpTRYWL | 4068 | 10.000 |
| 179 | HCV 1b | 29 | 164 | 10 | B_4403 | SEKNsGAGTW | 4069 | 36.000 |
| 180 | HCV 1b | 29 | 114 | 10 | B_4403 | MEVStATSGS | 4070 | 18.000 |
| 181 | HCV 1b | 29 | 66 | 10 | B_4403 | GETWwVVHVA | 4071 | 18.000 |
| 182 | HCV 1b | 29 | 32 | 9 | B_4403 | KESRTTTLF | 4072 | 90.000 |
| 183 | HCV 1b | 29 | 66 | 9 | B_4403 | GETWWVVHV | 4073 | 12.000 |
| 184 | HCV 1b | 30 | 64 | 9 | A1 | SLDWSQVLK | 4074 | 20.000 |
| 185 | HCV 1b | 30 | 84 | 10 | A_0201 | SLSHePEHGV | 4075 | 69.552 |
| 186 | HCV 1b | 30 | 8 | 10 | A_0201 | VLLQvLGPTI | 4076 | 65.622 |
| 187 | HCV 1b | 30 | 38 | 10 | A_0201 | MMPSpRQTPL | 4077 | 26.228 |
| 188 | HCV 1b | 30 | 68 | 10 | A_0201 | SQVLkSVNTV | 4078 | 16.219 |
| 189 | HCV 1b | 30 | 9 | 10 | A_0201 | LLQVlGPTIL | 4079 | 14.890 |
| 190 | HCV 1b | 30 | 3 | 10 | A_0201 | NVPChVLLQV | 4080 | 13.997 |
| 191 | HCV 1b | 30 | 17 | 9 | A_0201 | ILMEPFLTC | 4081 | 243.428 |
| 192 | HCV 1b | 30 | 22 | 9 | A_0201 | FLTCPVICA | 4082 | 52.561 |
| 193 | HCV 1b | 30 | 69 | 9 | A_0201 | QVLKSVNTV | 4083 | 51.790 |
| 194 | HCV 1b | 30 | 16 | 9 | A_0201 | TILMEPFLT | 4084 | 21.989 |
| 195 | HCV 1b | 30 | 9 | 9 | A_0201 | LLQVLGPTI | 4085 | 17.736 |
| 196 | HCV 1b | 30 | 8 | 9 | A_0201 | VLLQVLGPT | 4086 | 14.015 |
| 197 | HCV 1b | 30 | 63 | 9 | A24 | RSLDWSQVL | 4087 | 17.280 |
| 198 | HCV 1b | 30 | 46 | 10 | A3 | PLYPrWHEKK | 4088 | 45.000 |
| 199 | HCV 1b | 30 | 64 | 9 | A3 | SLDWSQVLK | 4089 | 20.000 |
| 200 | HCV 1b | 30 | 46 | 9 | A3 | PLYPRWHEK | 4090 | 15.000 |
| 201 | HCV 1b | 30 | 39 | 9 | B7 | MPSPRQTPL | 4091 | 80.000 |
| 202 | HCV 1b | 30 | 57 | 9 | B7 | TPGSCGRSL | 4092 | 80.000 |
| 203 | HCV 1b | 30 | 30 | 9 | B7 | APHGQVVCM | 4093 | 60.000 |
| 204 | HCV 1b | 30 | 4 | 10 | B7 | VPCHvLLQVL | 4094 | 80.000 |
| 205 | HCV 1b | 30 | 14 | 10 | B7 | GPTIIMEPFL | 4095 | 80.000 |
| 206 | HCV 1b | 30 | 30 | 10 | B7 | APHGqVVCMM | 4096 | 60.000 |
| 207 | HCV 1b | 30 | 76 | 10 | B7 | TVHIqSQTSL | 4097 | 20.000 |
| 208 | HCV 1b | 30 | 48 | 10 | B7 | YPRWhEKKGT | 4098 | 20.000 |
| 209 | HCV 1b | 30 | 39 | 9 | B8 | MPSPRQTPL | 4099 | 16.000 |
| 210 | HCV 1b | 30 | 30 | 9 | B_3501 | APHGQVVCM | 4100 | 40.000 |
| 211 | HCV 1b | 30 | 14 | 9 | B_3501 | GPTILMEPF | 4101 | 20.000 |

TABLE 4d-continued 1b (4-6)

| No. | Strain | ORF | Start | AA | HLA | Peptide sequence | SEQ ID NO: | Score |
|---|---|---|---|---|---|---|---|---|
| 212 | HCV 1b | 30 | 39 | 9 | B_3501 | MPSPRQTPL | 4102 | 20.000 |
| 213 | HCV 1b | 30 | 57 | 9 | B_3501 | TPGSCGRSL | 4103 | 20.000 |
| 214 | HCV 1b | 30 | 63 | 9 | B_3501 | RSLDWSQVL | 4104 | 20.000 |
| 215 | HCV 1b | 30 | 39 | 10 | B_3501 | MPSPrQTPLY | 4105 | 40.000 |
| 216 | HCV 1b | 30 | 30 | 10 | B_3501 | APHGqVVCMM | 4106 | 40.000 |
| 217 | HCV 1b | 30 | 14 | 10 | B_3501 | GPTIIMEPFL | 4107 | 20.000 |
| 218 | HCV 1b | 30 | 4 | 10 | B_3501 | VPCHvLLQVL | 4108 | 20.000 |
| 219 | HCV 1b | 30 | 87 | 10 | B_4403 | HEPEhGVEQS | 4109 | 12.000 |
| 220 | HCV 1b | 30 | 93 | 10 | B_4403 | VEQSsLIHWW | 4110 | 12.000 |
| 221 | HCV 1b | 30 | 93 | 9 | B_4403 | VEQSSLIHW | 4111 | 18.000 |
| 222 | HCV 1b | 31 | 5 | 10 | A_0201 | RLTRsSVEGI | 4112 | 11.758 |
| 223 | HCV 1b | 31 | 13 | 9 | A3 | GISPLMTLK | 4113 | 13.500 |
| 224 | HCV 1b | 31 | 9 | 10 | B_3501 | SSVEgISPLM | 4114 | 20.000 |
| 225 | HCV 1b | 31 | 8 | 10 | B_3501 | RSSVeGISPL | 4115 | 10.000 |
| 226 | HCV 1b | 32 | 35 | 10 | A1 | ATHPpKMLNR | 4116 | 12.500 |
| 227 | HCV 1b | 32 | 40 | 10 | A_0201 | KMLNrRVLWV | 4117 | 8.228.881 |
| 228 | HCV 1b | 32 | 41 | 10 | A_0201 | MLNRrVLWVV | 4118 | 836.241 |
| 229 | HCV 1b | 32 | 46 | 10 | A_0201 | VLWVvSGLVI | 4119 | 60.355 |
| 230 | HCV 1b | 32 | 52 | 10 | A_0201 | GLVIeAVNAI | 4120 | 23.995 |
| 231 | HCV 1b | 32 | 27 | 10 | A_0201 | ALGGaSWAAT | 4121 | 12.668 |
| 232 | HCV 1b | 32 | 49 | 10 | A_0201 | VVSGlVIEAV | 4122 | 11.660 |
| 233 | HCV 1b | 32 | 77 | 9 | A24 | KYCIPLMKF | 4123 | 220.000 |
| 234 | HCV 1b | 32 | 45 | 9 | A24 | RVLWVVSGL | 4124 | 16.800 |
| 235 | HCV 1b | 32 | 20 | 9 | B7 | APTKAEAAL | 4125 | 240.000 |
| 236 | HCV 1b | 32 | 74 | 9 | B7 | KPAKYCIPL | 4126 | 80.000 |
| 237 | HCV 1b | 32 | 34 | 9 | B7 | AATHPPKML | 4127 | 54.000 |
| 238 | HCV 1b | 32 | 45 | 9 | B7 | RVLWVVSGL | 4128 | 20.000 |
| 239 | HCV 1b | 32 | 6 | 9 | B7 | FPRPMLPTA | 4129 | 20.000 |
| 240 | HCV 1b | 32 | 74 | 10 | B7 | KPAKyCIPLM | 4130 | 20.000 |
| 241 | HCV 1b | 32 | 6 | 10 | B7 | FPRPmLPTAA | 4131 | 20.000 |
| 242 | HCV 1b | 32 | 33 | 10 | B7 | WAAThPPKML | 4132 | 18.000 |
| 243 | HCV 1b | 32 | 90 | 10 | B7 | AQNVsRARHL | 4133 | 12.000 |
| 244 | HCV 1b | 32 | 38 | 10 | B7 | PPKMlNRRVL | 4134 | 12.000 |
| 245 | HCV 1b | 32 | 74 | 10 | B_3501 | KPAKyCIPLM | 4135 | 80.000 |
| 246 | HCV 1b | 32 | 80 | 10 | B_3501 | IPLMkFHMCF | 4136 | 20.000 |
| 247 | HCV 1b | 32 | 125 | 10 | B_3501 | CSAScIPCSM | 4137 | 10.000 |
| 248 | HCV 1b | 32 | 1 | 10 | B_3501 | MSTStFPRPM | 4138 | 10.000 |
| 249 | HCV 1b | 32 | 74 | 9 | B_3501 | KPAKYCIPL | 4139 | 40.000 |
| 250 | HCV 1b | 32 | 20 | 9 | B_3501 | APTKAEAAL | 4140 | 20.000 |
| 251 | HCV 1b | 32 | 24 | 9 | B_4403 | AEAALGGAS | 4141 | 16.000 |
| 252 | HCV 1b | 32 | 24 | 10 | B_4403 | AEAAlGGASW | 4142 | 48.000 |
| 253 | HCV 1b | 32 | 55 | 10 | B_4403 | IEAVnAINDA | 4143 | 12.000 |
| 254 | HCV 1b | 33 | 31 | 9 | A1 | SADMHAMMY | 4144 | 125.000 |
| 255 | HCV 1b | 33 | 2 | 9 | A1 | TTLPVVRQY | 4145 | 12.500 |
| 256 | HCV 1b | 33 | 51 | 9 | A1 | WTAPSLYSK | 4146 | 10.000 |
| 257 | HCV 1b | 33 | 36 | 10 | A_0201 | AMMYIVMGWV | 4147 | 305.644 |
| 258 | HCV 1b | 33 | 39 | 9 | A_0201 | YLVMGWVRV | 4148 | 543.897 |
| 259 | HCV 1b | 33 | 37 | 9 | A_0201 | MMYLVMGWV | 4149 | 449.379 |
| 260 | HCV 1b | 33 | 3 | 9 | A_0201 | TLPVVRQYA | 4150 | 27.324 |
| 261 | HCV 1b | 33 | 16 | 10 | A24 | RTPPtSTQVL | 4151 | 17.280 |
| 262 | HCV 1b | 33 | 37 | 10 | A3 | MMYLvMGWVR | 4152 | 60.000 |
| 263 | HCV 1b | 33 | 17 | 9 | B7 | TPPTSTQVL | 4153 | 80.000 |
| 264 | HCV 1b | 33 | 14 | 9 | B7 | AARTPPTST | 4154 | 13.500 |
| 265 | HCV 1b | 33 | 53 | 9 | B7 | APSLYSKGV | 4155 | 12.000 |
| 266 | HCV 1b | 33 | 62 | 10 | B7 | GPCSvGFSRM | 4156 | 20.000 |
| 267 | HCV 1b | 33 | 28 | 10 | B7 | TSRSaDMHAM | 4157 | 10.000 |
| 268 | HCV 1b | 33 | 68 | 9 | B8 | FSRMRHFHI | 4158 | 20.000 |
| 269 | HCV 1b | 33 | 11 | 10 | B8 | AARAaRTPPT | 4159 | 16.000 |
| 270 | HCV 1b | 33 | 28 | 10 | B_3501 | TSRSaDMHAM | 4160 | 45.000 |
| 271 | HCV 1b | 33 | 30 | 10 | B_3501 | RSADmHAMMY | 4161 | 40.000 |
| 272 | HCV 1b | 33 | 62 | 10 | B_3501 | GPCSvGFSRM | 4162 | 40.000 |
| 273 | HCV 1b | 33 | 48 | 10 | B_3501 | TSFWtAPSLY | 4163 | 10.000 |
| 274 | HCV 1b | 33 | 30 | 9 | B_3501 | RSADMHAMM | 4164 | 40.000 |
| 275 | HCV 1b | 33 | 17 | 9 | B_3501 | TPPTSTQVL | 4165 | 20.000 |
| 276 | HCV 1b | 33 | 2 | 9 | B_4403 | TTLPVVRQY | 4166 | 54.000 |
| 277 | HCV 1b | 33 | 1 | 10 | B_4403 | MTTLpVVRQY | 4167 | 13.500 |
| 278 | HCV 1b | 34 | 15 | 10 | A_0201 | WSWQtGNPGV | 4168 | 17.334 |
| 279 | HCV 1b | 35 | 3 | 10 | B7 | EGRSpGVTNL | 4169 | 40.000 |
| 280 | HCV 1b | 36 | 3 | 9 | A3 | LLPLPVLPR | 4170 | 36.000 |
| 281 | HCV 1b | 36 | 9 | 10 | B7 | LPRRcERDTA | 4171 | 30.000 |
| 282 | HCV 1b | 36 | 1 | 9 | B7 | MPLLPLPVL | 4172 | 120.000 |
| 283 | HCV 1b | 36 | 9 | 9 | B7 | LPRRCERDT | 4173 | 20.000 |
| 284 | HCV 1b | 36 | 1 | 9 | B_3501 | MPLLPLPVL | 4174 | 20.000 |
| 285 | HCV 1b | 37 | 3 | 10 | A_0201 | KVGSkLKSTV | 4175 | 21.300 |
| 286 | HCV 1b | 37 | 20 | 9 | A_0201 | SITESKSPV | 4176 | 39.210 |

TABLE 4d-continued 1b (4-6)

| No. | Strain | ORF | Start | AA | HLA | Peptide sequence | SEQ ID NO: | Score |
|---|---|---|---|---|---|---|---|---|
| 287 | HCV 1b | 37 | 9 | 10 | A24 | KSTVwVTHVL | 4177 | 11.200 |
| 288 | HCV 1b | 37 | 17 | 9 | A3 | VLQSITESK | 4178 | 30.000 |
| 289 | HCV 1b | 37 | 9 | 10 | B_3501 | KSTVwVTHVL | 4179 | 10.000 |
| 290 | HCV 1b | 38 | | | | no hits | | |
| 291 | HCV 1b | 39 | 7 | 9 | A_0201 | LMASMGMAL | 4180 | 26.228 |
| 292 | HCV 1b | 39 | 3 | 9 | A_0201 | CLPPLMASM | 4181 | 11.426 |
| 293 | HCV 1b | 39 | 4 | 10 | B7 | LPPLmASMGM | 4182 | 20.000 |
| 294 | HCV 1b | 39 | 4 | 10 | B_3501 | LPPLmASMGM | 4183 | 40.000 |
| 295 | HCV 1b | 40 | 7 | 9 | A1 | VTDPGGVAV | 4184 | 25.000 |
| 296 | HCV 1b | 40 | 7 | 10 | A1 | VTDPgGVAVA | 4185 | 25.000 |
| 297 | HCV 1b | 40 | 6 | 10 | A_0201 | TVTDpGGVAV | 4186 | 24.952 |
| 298 | HCV 1b | 40 | 34 | 9 | B_3501 | MPKIVVESV | 4187 | 12.000 |
| 299 | HCV 1b | 40 | 25 | 10 | B_3501 | VSAWsRTVPM | 4188 | 10.000 |
| 300 | HCV 1b | 41 | 15 | 10 | A1 | ALDIyAPNPK | 4189 | 10.000 |
| 301 | HCV 1b | 41 | 7 | 10 | A_0201 | LMLGsIPCAL | 4190 | 97.045 |
| 302 | HCV 1b | 41 | 6 | 10 | A_0201 | VLMLgSIPCA | 4191 | 71.872 |
| 303 | HCV 1b | 41 | 35 | 10 | A_0201 | TLYPwAAYAA | 4192 | 15.898 |
| 304 | HCV 1b | 41 | 35 | 9 | A_0201 | TLYPWAAYA | 4193 | 87.437 |
| 305 | HCV 1b | 41 | 46 | 9 | A_0201 | TLVLLPLPV | 4194 | 69.552 |
| 306 | HCV 1b | 41 | 7 | 9 | A_0201 | LMLGSIPCA | 4195 | 51.908 |
| 307 | HCV 1b | 41 | 8 | 9 | A_0201 | MLGSIPCAL | 4196 | 36.316 |
| 308 | HCV 1b | 41 | 48 | 9 | A_0201 | VLLPLPVGA | 4197 | 31.249 |
| 309 | HCV 1b | 41 | 6 | 9 | A_0201 | VLMLGSIPC | 4198 | 31.249 |
| 310 | HCV 1b | 41 | 1 | 9 | A_0201 | MVLTPVLML | 4199 | 27.042 |
| 311 | HCV 1b | 41 | 41 | 9 | A24 | AYAAGTLVL | 4200 | 200.000 |
| 312 | HCV 1b | 41 | 41 | 10 | A24 | AYAAgTLVLL | 4201 | 200.000 |
| 313 | HCV 1b | 41 | 15 | 10 | A3 | ALDIyAPNPK | 4202 | 20.000 |
| 314 | HCV 1b | 41 | 1 | 9 | B7 | MVLTPVLML | 4203 | 30.000 |
| 315 | HCV 1b | 41 | 42 | 9 | B7 | YAAGTLVLL | 4204 | 12.000 |
| 316 | HCV 1b | 41 | 44 | 9 | B7 | AGTLVLLPL | 4205 | 12.000 |
| 317 | HCV 1b | 41 | 39 | 9 | B7 | WAAYAAGTL | 4206 | 12.000 |
| 318 | HCV 1b | 41 | 22 | 10 | B8 | NPKVaATDGL | 4207 | 16.000 |
| 319 | HCV 1b | 41 | 22 | 10 | B_3501 | NPKVaATDGL | 4208 | 60.000 |
| 320 | HCV 1b | 41 | 50 | 10 | B_3501 | LPLPvGACRW | 4209 | 10.000 |
| 321 | HCV 1b | 41 | 10 | 10 | B_3501 | GSIPcALDIY | 4210 | 10.000 |
| 322 | HCV 1b | 41 | 33 | 10 | B_3501 | TSTLyPWAAY | 4211 | 10.000 |
| 323 | HCV 1b | 41 | 10 | 10 | B_4403 | GSIPcALDIY | 4212 | 67.500 |
| 324 | HCV 1b | 41 | 28 | 10 | B_4403 | TDGLrTSTLY | 4213 | 22.500 |
| 325 | HCV 1b | 41 | 29 | 9 | B_4403 | DGLRTSTLY | 4214 | 27.000 |
| 326 | HCV 1b | 41 | 34 | 9 | B_4403 | STLYPWAAY | 4215 | 12.000 |
| 327 | HCV 1b | 42 | 2 | 10 | B_4403 | DSTGtKSTAF | 4216 | 10.125 |
| 328 | HCV 1b | 43 | | | | no hits | | |
| 329 | HCV 1b | 44 | 1 | 9 | A_0201 | MMQPSRPRV | 4217 | 85.394 |
| 330 | HCV 1b | 44 | 3 | 9 | B_3501 | QPSRPRVCW | 4218 | 10.000 |
| 331 | HCV 1b | 45 | 32 | 9 | A_0201 | KMMSPHAAV | 4219 | 650.504 |
| 332 | HCV 1b | 45 | 16 | 9 | B7 | GPRSISFPL | 4220 | 800.000 |
| 333 | HCV 1b | 45 | 71 | 9 | B7 | QSRSGVRWL | 4221 | 40.000 |
| 334 | HCV 1b | 45 | 7 | 9 | B7 | HPRPSRLSA | 4222 | 30.000 |
| 335 | HCV 1b | 45 | 16 | 9 | B8 | GPRSISFPL | 4223 | 16.000 |
| 336 | HCV 1b | 45 | 16 | 9 | B_3501 | GPRSISFPL | 4224 | 60.000 |
| 337 | HCV 1b | 45 | 71 | 9 | B_3501 | QSRSGVRWL | 4225 | 15.000 |
| 338 | HCV 1b | 45 | 30 | 9 | B_3501 | RPKMMSPHA | 4226 | 12.000 |
| 339 | HCV 1b | 45 | 26 | 9 | B_4403 | AETGRPKMM | 4227 | 18.000 |
| 340 | HCV 1b | 45 | 47 | 10 | A_0201 | ILVSmSEKTT | 4228 | 12.668 |
| 341 | HCV 1b | 45 | 45 | 10 | A3 | VMILvSMSEK | 4229 | 45.000 |
| 342 | HCV 1b | 45 | 39 | 10 | B7 | AVSApQVMIL | 4230 | 60.000 |
| 343 | HCV 1b | 45 | 42 | 10 | B7 | APQVmILVSM | 4231 | 60.000 |
| 344 | HCV 1b | 45 | 4 | 10 | B7 | RSRHpRPSRL | 4232 | 40.000 |
| 345 | HCV 1b | 45 | 70 | 10 | B7 | AQSRsGVRWL | 4233 | 12.000 |
| 346 | HCV 1b | 45 | 15 | 10 | B7 | AGPRsISFPL | 4234 | 12.000 |
| 347 | HCV 1b | 45 | 4 | 10 | B8 | RSRHpRPSRL | 4235 | 40.000 |
| 348 | HCV 1b | 45 | 61 | 10 | B8 | TARSrRPAWA | 4236 | 16.000 |
| 349 | HCV 1b | 45 | 42 | 10 | B_3501 | APQVmILVSM | 4237 | 40.000 |
| 350 | HCV 1b | 45 | 4 | 10 | B_3501 | RSRHpRPSRL | 4238 | 30.000 |
| 351 | HCV 1b | 45 | 30 | 10 | B_3501 | RPKMmSPHAA | 4239 | 12.000 |
| 352 | HCV 1b | 45 | 26 | 10 | B_4403 | AETGrPKMMS | 4240 | 12.000 |
| 353 | HCV 1b | 45 | 52 | 10 | B_4403 | SEKTtGSTAT | 4241 | 12.000 |
| 354 | HCV 1b | 46 | 1 | 9 | A24 | MYVPVSAPS | 4242 | 12.600 |
| 355 | HCV 1b | 46 | 3 | 9 | B7 | VPVSAPSFM | 4243 | 20.000 |
| 356 | HCV 1b | 46 | 3 | 9 | B_3501 | VPVSAPSFM | 4244 | 40.000 |
| 357 | HCV 1b | 46 | 7 | 9 | B_3501 | APSFMKAIW | 4245 | 10.000 |
| 358 | HCV 1b | 46 | 2 | 10 | A_0201 | YVPVsAPSFM | 4246 | 10.998 |
| 359 | HCV 1b | 46 | 1 | 10 | A24 | MYVPvSAPSF | 4247 | 180.000 |
| 360 | HCV 1b | 47 | 58 | 9 | A24 | KYCNHHMSL | 4248 | 400.000 |
| 361 | HCV 1b | 47 | 9 | 9 | B7 | GPSMASRSL | 4249 | 80.000 |

TABLE 4d-continued 1b (4-6)

| No. | Strain | ORF | Start | AA | HLA | Peptide sequence | SEQ ID NO: | Score |
|---|---|---|---|---|---|---|---|---|
| 362 | HCV 1b | 47 | 34 | 9 | B7 | MASRPPRTL | 4250 | 18.000 |
| 363 | HCV 1b | 47 | 9 | 9 | B_3501 | GPSMASRSL | 4251 | 20.000 |
| 364 | HCV 1b | 47 | 4 | 9 | B_3501 | WSTMSGPSM | 4252 | 10.000 |
| 365 | HCV 1b | 47 | 51 | 9 | B_4403 | CASALVIKY | 4253 | 13.500 |
| 366 | HCV 1b | 47 | 21 | 10 | A_0201 | KISSgWTAHV | 4254 | 33.472 |
| 367 | HCV 1b | 47 | 32 | 10 | A_0201 | RMMAsRPPRT | 4255 | 19.913 |
| 368 | HCV 1b | 47 | 58 | 10 | A24 | KYCNhHMSLA | 4256 | 10.000 |
| 369 | HCV 1b | 47 | 41 | 10 | A3 | TLRGgTHTCK | 4257 | 30.000 |
| 370 | HCV 1b | 47 | 13 | 10 | B7 | ASRSlVMSKI | 4258 | 12.000 |
| 371 | HCV 1b | 47 | 50 | 10 | B_4403 | KCASaLVIKY | 4259 | 27.000 |
| 372 | HCV 1b | 48 | 70 | 9 | A1 | TTDPTPYRY | 4260 | 1.250.000 |
| 373 | HCV 1b | 48 | 23 | 9 | A3 | ALRTTRFSK | 4261 | 60.000 |
| 374 | HCV 1b | 48 | 16 | 9 | B7 | CAPATDAAL | 4262 | 12.000 |
| 375 | HCV 1b | 48 | 56 | 9 | B_3501 | KSSRTYSHL | 4263 | 10.000 |
| 376 | HCV 1b | 48 | 21 | 9 | B_4403 | DAALRTTRF | 4264 | 13.500 |
| 377 | HCV 1b | 48 | 70 | 10 | A1 | TTDPtPYRYC | 4265 | 12.500 |
| 378 | HCV 1b | 48 | 19 | 10 | A1 | ATDAaLRTTR | 4266 | 12.500 |
| 379 | HCV 1b | 48 | 23 | 10 | A_0201 | ALRTtRFSKV | 4267 | 10.043 |
| 380 | HCV 1b | 48 | 75 | 10 | A24 | PYRYcTSTIF | 4268 | 10.000 |
| 381 | HCV 1b | 48 | 23 | 10 | B8 | ALRTtRFSKV | 4269 | 24.000 |
| 382 | HCV 1b | 48 | 51 | 10 | B8 | SARRrKSSRT | 4270 | 16.000 |
| 383 | HCV 1b | 48 | 67 | 10 | B_4403 | TETTtDPTPY | 4271 | 180.000 |
| 384 | HCV 1b | 48 | 20 | 10 | B_4403 | TDAAlRTTRF | 4272 | 22.500 |
| 385 | HCV 1b | 49 | | | | no hits | | |
| 386 | HCV 1b | 50 | 30 | 9 | A_0201 | VLLSSSTSV | 4273 | 437.482 |
| 387 | HCV 1b | 50 | 9 | 9 | A_0201 | VLVNPVLFI | 4274 | 224.357 |
| 388 | HCV 1b | 50 | 1 | 9 | A_0201 | MLHGGPPHV | 4275 | 118.238 |
| 389 | HCV 1b | 50 | 38 | 9 | A_0201 | VSFSPQLYV | 4276 | 15.707 |
| 390 | HCV 1b | 50 | 16 | 9 | A_0201 | FIHVQPNQL | 4277 | 13.512 |
| 391 | HCV 1b | 50 | 43 | 9 | A3 | QLYVGTPER | 4278 | 20.000 |
| 392 | HCV 1b | 50 | 24 | 9 | B7 | LPCGGRVLL | 4279 | 120.000 |
| 393 | HCV 1b | 50 | 52 | 9 | B7 | SVVPTTTGL | 4280 | 20.000 |
| 394 | HCV 1b | 50 | 24 | 9 | B_3501 | LPCGGRVLL | 4281 | 20.000 |
| 395 | HCV 1b | 50 | 57 | 9 | B_4403 | TTGLGVKQY | 4282 | 13.500 |
| 396 | HCV 1b | 50 | 37 | 10 | A_0201 | SVSFsPQLYV | 4283 | 33.472 |
| 397 | HCV 1b | 50 | 29 | 10 | A_0201 | RVLLsSSTSV | 4284 | 22.517 |
| 398 | HCV 1b | 50 | 23 | 10 | A_0201 | QLPCgGRVLL | 4285 | 21.362 |
| 399 | HCV 1b | 50 | 10 | 10 | A_0201 | LVNPvLFIHV | 4286 | 19.657 |
| 400 | HCV 1b | 50 | 1 | 10 | A_0201 | MLHGgPPHVL | 4287 | 14.890 |
| 401 | HCV 1b | 50 | 45 | 10 | A_0201 | YVGTpERSVV | 4288 | 11.478 |
| 402 | HCV 1b | 50 | 53 | 10 | A_0201 | VVPTtTGLGV | 4289 | 10.346 |
| 403 | HCV 1b | 50 | 15 | 10 | A24 | LFIHvQPNQL | 4290 | 36.000 |
| 404 | HCV 1b | 50 | 51 | 10 | A24 | RSVVpTTTGL | 4291 | 12.000 |
| 405 | HCV 1b | 50 | 67 | 10 | B_3501 | GPHTcDAGTI | 4292 | 12.000 |
| 406 | HCV 1b | 50 | 51 | 10 | B_3501 | RSVVpTTTGL | 4293 | 10.000 |
| 407 | HCV 1b | 50 | 36 | 10 | B_3501 | TSVSfSPQLY | 4294 | 10.000 |
| 408 | HCV 1b | 50 | 56 | 10 | B_4403 | TTTGLGVKQY | 4295 | 20.250 |
| 409 | HCV 1b | 51 | 6 | 10 | B7 | AMRSgHPDAL | 4296 | 120.000 |
| 410 | HCV 1b | 51 | 8 | 10 | B_3501 | RSGHpDALNL | 4297 | 15.000 |
| 411 | HCV 1b | 52 | 15 | 9 | A_0201 | LLMCQLPLV | 4298 | 1.006.209 |
| 412 | HCV 1b | 52 | 14 | 9 | A_0201 | VLLMCQLPL | 4299 | 134.369 |
| 413 | HCV 1b | 52 | 8 | 9 | A_0201 | SLQFRAVLL | 4300 | 21.362 |
| 414 | HCV 1b | 52 | 12 | 9 | A24 | RAVLLMCQL | 4301 | 14.400 |
| 415 | HCV 1b | 52 | 12 | 9 | B7 | RAVLLMCQL | 4302 | 12.000 |
| 416 | HCV 1b | 52 | 14 | 10 | A_0201 | VLLMcQLPLV | 4303 | 1.006.209 |
| 417 | HCV 1b | 52 | 19 | 10 | A_0201 | QLPLvFTSWI | 4304 | 218.046 |
| 418 | HCV 1b | 52 | 16 | 10 | A_0201 | LMCQlPLVFT | 4305 | 115.740 |
| 419 | HCV 1b | 52 | 8 | 10 | A_0201 | SLQFrAVLLM | 4306 | 11.426 |
| 420 | HCV 1b | 52 | 13 | 10 | B7 | AVLLmCQLPL | 4307 | 60.000 |
| 421 | HCV 1b | 52 | 2 | 10 | B_3501 | NPVWrESLQF | 4308 | 30.000 |
| 422 | HCV 1b | 52 | 20 | 10 | B_3501 | LPLVfTSWIF | 4309 | 20.000 |
| 423 | HCV 1b | 53 | | | | no hits | | |
| 424 | HCV 1b | 54 | 1 | 9 | A_0201 | MLLFLAASV | 4310 | 437.482 |
| 425 | HCV 1b | 54 | 19 | 9 | A_0201 | KLLSRTQGT | 4311 | 96.503 |
| 426 | HCV 1b | 54 | 42 | 9 | A_0201 | ILELEQSFV | 4312 | 41.620 |
| 427 | HCV 1b | 54 | 33 | 9 | A_0201 | MIMSAASYT | 4313 | 35.448 |
| 428 | HCV 1b | 54 | 34 | 9 | A_0201 | IMSAASYTI | 4314 | 12.809 |
| 429 | HCV 1b | 54 | 37 | 9 | B7 | AASYTILEL | 4315 | 36.000 |
| 430 | HCV 1b | 54 | 12 | 9 | B7 | SATQQREKL | 4316 | 18.000 |
| 431 | HCV 1b | 54 | 13 | 9 | B7 | ATQQREKLL | 4317 | 12.000 |
| 432 | HCV 1b | 54 | 45 | 9 | B_4403 | LEQSFVTWY | 4318 | 540.000 |
| 433 | HCV 1b | 54 | 43 | 9 | B_4403 | LELEQSFVT | 4319 | 12.000 |
| 434 | HCV 1b | 54 | 44 | 10 | A1 | ELEQsFVTWY | 4320 | 45.000 |
| 435 | HCV 1b | 54 | 41 | 10 | A_0201 | TILElEQSFV | 4321 | 797.922 |
| 436 | HCV 1b | 54 | 2 | 10 | A_0201 | LLFLaASVGV | 4322 | 437.482 |

TABLE 4d-continued 1b (4-6)

| No. | Strain | ORF | Start | AA | HLA | Peptide sequence | SEQ ID NO: | Score |
|---|---|---|---|---|---|---|---|---|
| 437 | HCV 1b | 54 | 32 | 10 | A_0201 | CMIMsAASYT | 4323 | 29.601 |
| 438 | HCV 1b | 54 | 4 | 10 | A_0201 | FLAAsVGVSA | 4324 | 22.853 |
| 439 | HCV 1b | 54 | 34 | 10 | A_0201 | IMSAaSYTIL | 4325 | 16.130 |
| 440 | HCV 1b | 54 | 45 | 10 | A_0201 | LEQSfVTWYI | 4326 | 14.226 |
| 441 | HCV 1b | 54 | 44 | 10 | A3 | ELEQsFVTWY | 4327 | 10.800 |
| 442 | HCV 1b | 54 | 49 | 10 | B7 | FVTWyIPDTL | 4328 | 20.000 |
| 443 | HCV 1b | 54 | 12 | 10 | B7 | SATQqREKLL | 4329 | 12.000 |
| 444 | HCV 1b | 54 | 36 | 10 | B7 | SAASyTILEL | 4330 | 12.000 |
| 445 | HCV 1b | 54 | 12 | 10 | B8 | SATQqREKLL | 4331 | 16.000 |
| 446 | HCV 1b | 54 | 43 | 10 | B_4403 | LELEqSFVTW | 4332 | 24.000 |
| 447 | HCV 1b | 54 | 31 | 10 | B_4403 | VCMImSAASY | 4333 | 13.500 |
| 448 | HCV 1b | 55 | 14 | 9 | A_0201 | KEQPGRFPV | 4334 | 27.454 |
| 449 | HCV 1b | 55 | 12 | 9 | B_4403 | IEKEQPGRF | 4335 | 40.000 |
| 450 | HCV 1b | 55 | 14 | 9 | B_4403 | KEQPGRFPV | 4336 | 12.000 |
| 451 | HCV 1b | 56 | 42 | 9 | B7 | HPAHPIPSL | 4337 | 120.000 |
| 452 | HCV 1b | 56 | 12 | 9 | B7 | RVSMTLPKL | 4338 | 20.000 |
| 453 | HCV 1b | 56 | 42 | 9 | B_3501 | HPAHPIPSL | 4339 | 20.000 |
| 454 | HCV 1b | 56 | 8 | 10 | A24 | KPHVrVSMTL | 4340 | 11.200 |
| 455 | HCV 1b | 56 | 8 | 10 | B7 | KPHVrVSMTL | 4341 | 80.000 |
| 456 | HCV 1b | 56 | 35 | 10 | B7 | EPRGdRSHPA | 4342 | 20.000 |
| 457 | HCV 1b | 56 | 2 | 10 | B7 | YPMRsAKPHV | 4343 | 12.000 |
| 458 | HCV 1b | 56 | 35 | 10 | B8 | EPRGdRSHPA | 4344 | 32.000 |
| 459 | HCV 1b | 56 | 19 | 10 | B8 | KLRDlRRGSV | 4345 | 18.000 |
| 460 | HCV 1b | 56 | 8 | 10 | B_3501 | KPHVrVSMTL | 4346 | 40.000 |
| 461 | HCV 1b | 56 | 6 | 10 | B_3501 | SAKPhRVSM | 4347 | 18.000 |
| 462 | HCV 1b | 57 | 15 | 9 | A24 | PYQAVPQGL | 4348 | 50.400 |
| 463 | HCV 1b | 57 | 22 | 9 | A3 | GLSRPNTTR | 4349 | 18.000 |
| 464 | HCV 1b | 57 | 23 | 9 | B7 | LSRPNTTRL | 4350 | 40.000 |
| 465 | HCV 1b | 57 | 8 | 9 | B_3501 | LPGHSQAPY | 4351 | 40.000 |
| 466 | HCV 1b | 57 | 23 | 9 | B_3501 | LSRPNTTRL | 4352 | 15.000 |
| 467 | HCV 1b | 57 | 22 | 10 | A_0201 | GLSRpNTTRL | 4353 | 21.362 |
| 468 | HCV 1b | 57 | 14 | 10 | B7 | APYQaVPQGL | 4354 | 240.000 |
| 469 | HCV 1b | 57 | 14 | 10 | B_3501 | APYQaVPQGL | 4355 | 20.000 |
| 470 | HCV 1b | 58 | 63 | 9 | A1 | QVDAYPYRK | 4356 | 20.000 |
| 471 | HCV 1b | 58 | 2 | 9 | A_0201 | RLTDLSQLA | 4357 | 20.369 |
| 472 | HCV 1b | 58 | 46 | 9 | A24 | KWPIGLECL | 4358 | 12.000 |
| 473 | HCV 1b | 58 | 63 | 9 | A3 | QVDAYPYRK | 4359 | 18.000 |
| 474 | HCV 1b | 58 | 43 | 9 | B7 | KNRKWPIGL | 4360 | 40.000 |
| 475 | HCV 1b | 58 | 61 | 9 | B_4403 | GEQVDAYPY | 4361 | 180.000 |
| 476 | HCV 1b | 58 | 60 | 10 | A1 | VGEQvDAYPY | 4362 | 22.500 |
| 477 | HCV 1b | 58 | 2 | 10 | A_0201 | RLTDLSQLAV | 4363 | 285.163 |
| 478 | HCV 1b | 58 | 55 | 10 | B7 | APRSsVGEQV | 4364 | 120.000 |
| 479 | HCV 1b | 58 | 11 | 10 | B7 | VTRAkMEPPL | 4365 | 40.000 |
| 480 | HCV 1b | 58 | 55 | 10 | B_3501 | APRSsVGEQV | 4366 | 12.000 |
| 481 | HCV 1b | 58 | 58 | 10 | B_3501 | SSVGeQVDAY | 4367 | 10.000 |
| 482 | HCV 1b | 58 | 58 | 10 | B_4403 | SSVGeQVDAY | 4368 | 54.000 |
| 483 | HCV 1b | 59 | 1 | 9 | B_3501 | MSPDSQGWY | 4369 | 20.000 |
| 484 | HCV 1b | 60 | | | | no hits | | |
| 485 | HCV 1b | 61 | 2 | 9 | B7 | WGRQLAGFL | 4370 | 40.000 |
| 486 | HCV 1b | 62 | 7 | 9 | B7 | VAQRVDGQL | 4371 | 12.000 |
| 487 | HCV 1b | 62 | 10 | 10 | A1 | RVDGqLAFLR | 4372 | 25.000 |
| 488 | HCV 1b | 62 | 6 | 10 | A24 | RVAQrVDGQL | 4373 | 11.200 |
| 489 | HCV 1b | 62 | 6 | 10 | B7 | RVAQrVDGQL | 4374 | 20.000 |
| 490 | HCV 1b | 63 | 7 | 9 | A24 | RLQGRRRQL | 4375 | 12.000 |
| 491 | HCV 1b | 64 | 16 | 9 | B7 | TVFDMSGDL | 4376 | 20.000 |
| 492 | HCV 1b | 64 | 12 | 9 | B7 | DPHGTVFDM | 4377 | 20.000 |
| 493 | HCV 1b | 64 | 34 | 9 | B7 | DAVSPPDSL | 4378 | 18.000 |
| 494 | HCV 1b | 64 | 12 | 9 | B_3501 | DPHGTVFDM | 4379 | 40.000 |
| 495 | HCV 1b | 64 | 37 | 10 | B7 | SPPDsLVPAL | 4380 | 80.000 |
| 496 | HCV 1b | 64 | 37 | 10 | B_3501 | SPPDsLVPAL | 4381 | 40.000 |
| 497 | HCV 1b | 64 | 9 | 10 | B_3501 | RPDDpHGTVF | 4382 | 24.000 |
| 498 | HCV 1b | 65 | 53 | 9 | B7 | KPRSSRLRL | 4383 | 1.200.000 |
| 499 | HCV 1b | 65 | 53 | 9 | B_3501 | KPRSSRLRL | 4384 | 120.000 |
| 500 | HCV 1b | 65 | 28 | 10 | A_0201 | RQGHLLDVWV | 4385 | 38.785 |
| 501 | HCV 1b | 65 | 53 | 10 | B7 | KPRSsRLRLV | 4386 | 40.000 |
| 502 | HCV 1b | 65 | 53 | 10 | B8 | KPRSsRLRLV | 4387 | 24.000 |
| 503 | HCV 1b | 65 | 23 | 10 | B8 | DLSSiRQGHL | 4388 | 16.000 |
| 504 | HCV 1b | 65 | 53 | 10 | B_3501 | KPRSsRLRLV | 4389 | 24.000 |
| 505 | HCV 1b | 65 | 4 | 10 | B_4403 | NEMPsPPDGF | 4390 | 160.000 |
| 506 | HCV 1b | 66 | 42 | 9 | B7 | DVGVNTVCL | 4391 | 20.000 |
| 507 | HCV 1b | 66 | 14 | 9 | B7 | RATTIGKKL | 4392 | 12.000 |
| 508 | HCV 1b | 67 | | | | no hits | | |
| 509 | HCV 1b | 68 | 25 | 9 | A_0201 | NLSLDLVLV | 4393 | 159.970 |
| 510 | HCV 1b | 68 | 16 | 9 | A_0201 | GLCCGGNHL | 4394 | 21.362 |
| 511 | HCV 1b | 68 | 1 | 9 | A_0201 | MVNGPTHAV | 4395 | 10.346 |

TABLE 4d-continued 1b (4-6)

| No. | Strain | ORF | Start | AA | HLA | Peptide sequence | SEQ ID NO: | Score |
|---|---|---|---|---|---|---|---|---|
| 512 | HCV 1b | 68 | 29 | 9 | A3 | DLVLVPACK | 4396 | 13.500 |
| 513 | HCV 1b | 68 | 8 | 10 | B7 | AVDAgRQEGL | 4397 | 18.000 |
| 514 | HCV 1b | 69 | 12 | 9 | A_0201 | QLHEGHLDI | 4398 | 42.774 |
| 515 | HCV 1b | 69 | 10 | 9 | A24 | RAQLHEGHL | 4399 | 12.000 |
| 516 | HCV 1b | 69 | 10 | 9 | B7 | RAQLHEGHL | 4400 | 12.000 |
| 517 | HCV 1b | 69 | 4 | 10 | B7 | NVRAcQRAQL | 4401 | 300.000 |
| 518 | HCV 1b | 70 | 18 | 9 | B_4403 | LEHHERTEY | 4402 | 180.000 |
| 519 | HCV 1b | 70 | 17 | 10 | A1 | SLEHhERTEY | 4403 | 45.000 |
| 520 | HCV 1b | 70 | 9 | 10 | B7 | EVRHsGYASL | 4404 | 200.000 |
| 521 | HCV 1b | 70 | 6 | 10 | B_3501 | SAHEvRHSGY | 4405 | 12.000 |
| 522 | HCV 1b | 71 | 19 | 9 | A1 | RGDPHLQVR | 4406 | 12.500 |
| 523 | HCV 1b | 71 | 19 | 10 | A24 | RGDPhLQVRL | 4407 | 11.520 |
| 524 | HCV 1b | 71 | 25 | 10 | B7 | QVRLgPGDKI | 4408 | 30.000 |
| 525 | HCV 1b | 72 | | | | no hits | | |
| 526 | HCV 1b | 73 | | | | no hits | | |
| 527 | HCV 1b | 74 | 2 | 9 | A24 | VYPGHVAHL | 4409 | 300.000 |
| 528 | HCV 1b | 74 | 1 | 10 | A_0201 | MVYPgHVAHL | 4410 | 23.388 |
| 529 | HCV 1b | 74 | 2 | 10 | A24 | VYPGhVAHLV | 4411 | 10.500 |
| 530 | HCV 1b | 74 | 2 | 9 | A24 | VYPGhVAHLV | 4411 | 10.500 |
| 530 | HCV 1b | 74 | 1 | 10 | B7 | MVYPgHVAHL | 4412 | 20.000 |
| 531 | HCV 1b | 75 | | | | no hits | | |

TABLE 4e 2a (1-3)

| No. | Strain | ORF | Start | AA | HLA | Peptide sequence | SEQ ID NO | Score |
|---|---|---|---|---|---|---|---|---|
| 1 | 2a | 1 | 2 | 9 | B3501 | TPGIGRVTW | 44413 | 10 |
| 2 | 2a | 2 | 40 | 9 | A0201 | QMWLCSSAA | 4414 | 29.78 |
| 3 | 2a | 2 | 35 | 9 | A24 | GYRSHQMWL | 4415 | 200 |
| 4 | 2a | 2 | 3 | 10 | B3501 | VPMTASPGSF | 4416 | 20 |
| 5 | 2a | 2 | 19 | 10 | B3501 | SPGASRAREW | 4417 | 10 |
| 6 | 2a | 2 | 34 | 10 | B7 | AGYRSHQMWL | 4418 | 12 |
| 7 | 2a | 2 | 22 | 9 | B7 | ASRAREWEI | 4419 | 12 |
| 8 | 2a | 2 | 22 | 9 | B8 | ASRAREWEI | 4420 | 20 |
| 9 | 2a | 4 | 16 | 10 | A0201 | ILTPLTSNVV | 4421 | 48.478 |
| 10 | 2a | 4 | 15 | 10 | A0201 | SILTPLTSNV | 4422 | 35.385 |
| 11 | 2a | 4 | 11 | 10 | A0201 | TVLGSILTPL | 4423 | 15.907 |
| 12 | 2a | 4 | 12 | 10 | A0201 | VLGSILTPLT | 4424 | 12.668 |
| 13 | 2a | 4 | 16 | 9 | A0201 | ILTPLTSNV | 4425 | 118.238 |
| 14 | 2a | 4 | 12 | 9 | A0201 | VLGSILTPL | 4426 | 83.527 |
| 15 | 2a | 4 | 5 | 9 | A24 | TFCAPRTVL | 4427 | 20 |
| 16 | 2a | 4 | 8 | 10 | B3501 | APRTVLGSIL | 4428 | 60 |
| 17 | 2a | 4 | 8 | 9 | B3501 | APRTVLGSI | 4429 | 24 |
| 18 | 2a | 4 | 18 | 9 | B3501 | TPLTSNVVL | 4430 | 20 |
| 19 | 2a | 4 | 27 | 9 | B3501 | GPGSRRGAW | 4431 | 10 |
| 20 | 2a | 4 | 8 | 10 | B7 | APRTVLGSIL | 4432 | 2400 |
| 21 | 2a | 4 | 11 | 10 | B7 | TVLGSILTPL | 4433 | 20 |
| 22 | 2a | 4 | 8 | 9 | B7 | APRTVLGSI | 4434 | 240 |
| 23 | 2a | 4 | 18 | 9 | B7 | TPLTSNVVL | 4435 | 80 |
| 24 | 2a | 4 | 8 | 10 | B8 | APRTVLGSIL | 4436 | 16 |
| 25 | 2a | 4 | 6 | 8 | B8 | FCAPRTVL | 4437 | 16 |
| 26 | 2a | 5 | 5 | 8 | B3501 | LPLQNMSF | 4438 | 20 |
| 27 | 2a | 6 | 4 | 10 | A0201 | YILSSFSWLL | 4439 | 1424.811 |
| 28 | 2a | 6 | 9 | 10 | A0201 | FSWLLGTSKV | 4440 | 17.334 |
| 29 | 2a | 6 | 5 | 9 | A0201 | ILSSFSWLL | 4441 | 1035.008 |
| 30 | 2a | 6 | 4 | 9 | A0201 | YILSSFSWL | 4442 | 522.431 |
| 31 | 2a | 6 | 44 | 9 | A0201 | RLMPMMHLC | 4443 | 42.278 |
| 32 | 2a | 6 | 44 | 10 | A1 | RLMPMMHLCK | 4444 | 10 |
| 33 | 2a | 6 | 3 | 10 | A24 | SYILSSFSWL | 4445 | 360 |
| 34 | 2a | 6 | 45 | 9 | A3 | LWPMMHLCK | 4446 | 40 |
| 35 | 2a | 6 | 37 | 10 | B3501 | CSSHCPNRLM | 4447 | 10 |
| 36 | 2a | 6 | 41 | 8 | B3501 | CPNRLMPM | 4448 | 40 |
| 37 | 2a | 6 | 23 | 9 | B3501 | WPPIPSPAY | 4449 | 40 |
| 38 | 2a | 6 | 28 | 9 | B3501 | SPAYGPFAY | 4450 | 40 |
| 39 | 2a | 6 | 41 | 9 | B3501 | CPNRLMPMM | 4451 | 40 |
| 40 | 2a | 6 | 26 | 9 | B3501 | IPSPAYGPF | 4452 | 20 |
| 41 | 2a | 6 | 38 | 9 | B3501 | SSHCPNRLM | 4453 | 10 |
| 42 | 2a | 6 | 41 | 9 | B7 | CPNRLMPMM | 4454 | 20 |
| 43 | 2a | 7 | 2 | 10 | A0201 | ALYGLPPYSA | 4455 | 15.898 |
| 44 | 2a | 7 | 5 | 9 | A0201 | GLPPYSARV | 4456 | 69.552 |
| 45 | 2a | 7 | 8 | 9 | A24 | PYSARVWCL | 4457 | 20 |

TABLE 4e-continued 2a (1-3)

| No. Strain | ORF | Start | AA | HLA | Peptide sequence | SEQ ID NO | Score |
|---|---|---|---|---|---|---|---|
| 46 2a | 8 | 10 | 10 | A3 | GLPTACGTWR | 4458 | 12 |
| 47 2a | 8 | 4 | 8 | B3501 | SPLCRIGL | 4459 | 20 |
| 48 2a | 8 | 11 | 8 | B3501 | LPTACGTW | 4460 | 10 |
| 49 2a | 8 | 13 | 9 | B7 | TACGTWRSL | 4461 | 12 |
| 50 2a | 8 | 4 | 8 | B8 | SPLCRIGL | 4462 | 16 |
| 51 2a | 9 | 21 | 8 | B3501 | TPPRGGSF | 4463 | 20 |
| 52 2a | 9 | 5 | 9 | B3501 | CPPDSVGRF | 4464 | 40 |
| 53 2a | 9 | 35 | 9 | B3501 | TPSRHEVSW | 4465 | 10 |
| 54 2a | 9 | 9 | 10 | B7 | SVGRFSLAQL | 4466 | 20 |
| 55 2a | 9 | 10 | 9 | B7 | VGRFSLAQL | 4467 | 40 |
| 56 2a | 10 | 8 | 10 | A24 | KAPKSLSRTL | 4468 | 14.4 |
| 57 2a | 10 | 9 | 9 | B3501 | APKSLSRTL | 4469 | 60 |
| 58 2a | 10 | 8 | 10 | B7 | KAPKSLSRTL | 4470 | 12 |
| 59 2a | 10 | 9 | 9 | B7 | APKSLSRTL | 4471 | 240 |
| 60 2a | 10 | 5 | 9 | B7 | AVEKAPKSL | 4472 | 18 |
| 61 2a | 10 | 9 | 9 | B8 | APKSLSRTL | 4473 | 16 |
| 62 2a | 11 | 4 | 10 | B3501 | IPTLGLESEL | 4474 | 20 |
| 63 2a | 11 | 4 | 10 | B7 | IPTLGLESEL | 4475 | 80 |
| 64 2a | 11 | 1 | 9 | B7 | MASIPTLGL | 4476 | 18 |
| 65 2a | 12 | 19 | 10 | A0201 | YATNATPWTL | 4477 | 10.236 |
| 66 2a | 12 | 33 | 10 | A1 | ASEQFLTKQR | 4478 | 13.5 |
| 67 2a | 12 | 28 | 10 | B3501 | LPPSSASEQF | 4479 | 20 |
| 68 2a | 12 | 11 | 9 | B3501 | RAAPMTSSY | 4480 | 12 |
| 69 2a | 12 | 11 | 9 | B4403 | RAAPMTSSY | 4481 | 18 |
| 70 2a | 12 | 19 | 10 | B7 | YATNATPWTL | 4482 | 12 |
| 71 2a | 12 | 13 | 9 | B7 | APMTSSYAT | 4483 | 18 |
| 72 2a | 12 | 20 | 9 | B7 | ATNATPWTL | 4484 | 12 |
| 73 2a | 14 | 12 | 10 | A0201 | MLWHTTEGWT | 4485 | 75.181 |
| 74 2a | 14 | 8 | 9 | A0201 | GAWAMLWHT | 4486 | 14.819 |
| 75 2a | 14 | 5 | 10 | B3501 | RPFGAWAMLW | 4487 | 20 |
| 76 2a | 14 | 5 | 8 | B3501 | RPFGAWAM | 4488 | 80 |
| 77 2a | 14 | 5 | 9 | B3501 | RPFGAWAML | 4489 | 40 |
| 78 2a | 14 | 4 | 10 | B3901 | RRPFGAWAML | 4490 | 15 |
| 79 2a | 14 | 5 | 9 | B7 | RPFGAWAML | 4491 | 80 |
| 80 2a | 15 | 5 | 10 | A1 | VSEPQGCLIA | 4492 | 67.5 |
| 81 2a | 15 | 5 | 9 | A1 | VSEPQGCLI | 4493 | 13.5 |
| 82 2a | 15 | 26 | 10 | A24 | RGMSLRQRRL | 4494 | 12 |
| 83 2a | 15 | 6 | 10 | B4403 | SEPQGCLIAW | 4495 | 36 |
| 84 2a | 15 | 26 | 10 | B7 | RGMSLRQRRL | 4496 | 12 |
| 85 2a | 15 | 4 | 9 | B7 | LVSEPQGCL | 4497 | 30 |
| 86 2a | 15 | 17 | 9 | B7 | SVSATTQGL | 4498 | 20 |
| 87 2a | 16 | 5 | 10 | B3501 | FPKQSNRGRI | 4499 | 24 |
| 88 2a | 16 | 5 | 10 | B7 | FPKQSNRGRI | 4500 | 12 |
| 89 2a | 17 | 3 | 10 | A0201 | LLMKWRNVPL | 4501 | 134.369 |
| 90 2a | 17 | 2 | 9 | A0201 | RLLMKWRNV | 4502 | 87.496 |
| 91 2a | 17 | 8 | 10 | A24 | RNVPLKRLSL | 4503 | 14.4 |
| 92 2a | 17 | 4 | 10 | A3 | LMKWRNVPLK | 4504 | 60 |
| 93 2a | 17 | 16 | 10 | A3 | SLKRGSGWPR | 4505 | 12 |
| 94 2a | 17 | 10 | 8 | B3501 | VPLKRLSL | 4506 | 20 |
| 95 2a | 17 | 3 | 10 | B7 | LLMKWRNVPL | 4507 | 12 |
| 96 2a | 17 | 9 | 9 | B7 | NVPLKRLSL | 4508 | 30 |
| 97 2a | 17 | 10 | 8 | B8 | VPLKRLSL | 4509 | 16 |
| 98 2a | 17 | 4 | 9 | B8 | LMKWRNVPL | 4510 | 80 |
| 99 2a | 18 | 15 | 10 | A0201 | TLARSPPWRT | 4511 | 55.89 |
| 100 2a | 18 | 26 | 9 | A0201 | SICCLGFCL | 4512 | 17.037 |
| 101 2a | 18 | 9 | 10 | A3302 | SSHSRSTLAR | 4513 | 15 |
| 102 2a | 18 | 7 | 10 | B3501 | GPSSHSRSTL | 4514 | 20 |
| 103 2a | 18 | 7 | 10 | B7 | GPSSHSRSTL | 4515 | 120 |
| 104 2a | 20 | 4 | 9 | A0201 | RLPLGSIHL | 4516 | 21.362 |
| 105 2a | 20 | 4 | 9 | A24 | RLPLGSIHL | 4517 | 12 |
| 106 2a | 20 | 5 | 8 | B3501 | LPLGSIHL | 4518 | 20 |
| 107 2a | 20 | 2 | 9 | B3501 | RSRLPLGSI | 4519 | 12 |
| 108 2a | 21 | 1 | 10 | A0201 | MMWTWWMPTC | 4520 | 116.441 |
| 109 2a | 21 | 1 | 9 | A0201 | MMWTWWMPT | 4521 | 129.098 |
| 110 2a | 21 | 6 | 9 | A0201 | WMPTCSWGA | 4522 | 123.786 |
| 111 2a | 21 | 7 | 9 | B3501 | MPTCSWGAM | 4523 | 40 |
| 112 2a | 21 | 7 | 9 | B7 | MPTCSWGAM | 4524 | 20 |
| 113 2a | 22 | 37 | 10 | A0201 | LMSWPFRRQV | 4525 | 64.9 |
| 114 2a | 22 | 57 | 10 | A0201 | SLGIQTWSPT | 4526 | 12.668 |
| 115 2a | 22 | 6 | 10 | B3501 | WPSKPSASPL | 4527 | 20 |
| 116 2a | 22 | 35 | 8 | B3501 | RPLMSWPF | 4528 | 40 |
| 117 2a | 22 | 30 | 8 | B3501 | TPAVGRPL | 4529 | 20 |
| 118 2a | 22 | 40 | 8 | B3501 | WPFRRQVL | 4530 | 20 |
| 119 2a | 22 | 51 | 8 | B3501 | CPPSRGSL | 4531 | 20 |
| 120 2a | 22 | 30 | 9 | B3501 | TPAVGRPLM | 4532 | 40 |

TABLE 4e-continued 2a (1-3)

| No. | Strain | ORF | Start | AA | HLA | Peptide sequence | SEQ ID NO | Score |
|---|---|---|---|---|---|---|---|---|
| 121 | 2a | 22 | 6 | 10 | B7 | WPSKPSASPL | 4533 | 80 |
| 122 | 2a | 22 | 49 | 10 | B7 | PPCPPSRGSL | 4534 | 12 |
| 123 | 2a | 22 | 30 | 9 | B7 | TPAVGRPLM | 4535 | 30 |
| 124 | 2a | 22 | 40 | 8 | B8 | WPFRRQVL | 4536 | 16 |
| 125 | 2a | 22 | 51 | 8 | B8 | CPPSRGSL | 4537 | 16 |
| 126 | 2a | 24 | 55 | 10 | A0201 | KQLALSFTLT | 4538 | 18.59 |
| 127 | 2a | 24 | 57 | 10 | A0201 | LALSFTLTSV | 4539 | 13.975 |
| 128 | 2a | 24 | 75 | 9 | A0201 | FMMSHKSFL | 4540 | 1444.253 |
| 129 | 2a | 24 | 55 | 9 | A0201 | KQLALSFTL | 4541 | 162.682 |
| 130 | 2a | 24 | 58 | 9 | A0201 | ALSFTLTSV | 4542 | 159.97 |
| 131 | 2a | 24 | 56 | 9 | A0201 | QLALSFTLT | 4543 | 14.159 |
| 132 | 2a | 24 | 47 | 9 | A1 | WTPPRGVRK | 4544 | 10 |
| 133 | 2a | 24 | 7 | 10 | A24 | RFAACPGGPL | 4545 | 40 |
| 134 | 2a | 24 | 55 | 9 | A24 | KQLALSFTL | 4546 | 14.4 |
| 135 | 2a | 24 | 51 | 9 | A24 | RGVRKQLAL | 4547 | 12 |
| 136 | 2a | 24 | 75 | 10 | A3 | FMMSHKSFLR | 4548 | 18 |
| 137 | 2a | 24 | 32 | 10 | A3 | HQFLRPSWPK | 4549 | 13.5 |
| 138 | 2a | 24 | 76 | 9 | A3 | MMSHKSFLR | 4550 | 12 |
| 139 | 2a | 24 | 48 | 10 | B3501 | TPPRGVRKQL | 4551 | 20 |
| 140 | 2a | 24 | 73 | 10 | B3501 | WPFMMSHKSF | 4552 | 20 |
| 141 | 2a | 24 | 68 | 10 | B3501 | GSARRWPFMM | 4553 | 10 |
| 142 | 2a | 24 | 69 | 8 | B3501 | SARRWPFM | 4554 | 18 |
| 143 | 2a | 24 | 20 | 8 | B3501 | SPCGRTSW | 4555 | 10 |
| 144 | 2a | 24 | 39 | 9 | B3501 | WPKMRCSAW | 4556 | 30 |
| 145 | 2a | 24 | 69 | 9 | B3501 | SARRWPFMM | 4557 | 18 |
| 146 | 2a | 24 | 68 | 9 | B3501 | GSARRWPFM | 4558 | 10 |
| 147 | 2a | 24 | 48 | 10 | B7 | TPPRGVRKQL | 4559 | 120 |
| 148 | 2a | 24 | 58 | 10 | B7 | ALSFTLTSVL | 4560 | 12 |
| 149 | 2a | 24 | 49 | 9 | B7 | PPRGVRKQL | 4561 | 120 |
| 150 | 2a | 24 | 69 | 9 | B7 | SARRWPFMM | 4562 | 30 |
| 151 | 2a | 24 | 8 | 9 | B7 | FAACPGGPL | 4563 | 18 |
| 152 | 2a | 24 | 75 | 9 | B7 | FMMSHKSFL | 4564 | 12 |
| 153 | 2a | 24 | 34 | 9 | B7 | FLRPSWPKM | 4565 | 10 |
| 154 | 2a | 24 | 39 | 8 | B8 | WPKMRCSA | 4566 | 16 |
| 155 | 2a | 26 | 23 | 10 | A0201 | RLAPCLRRPV | 4567 | 13.91 |
| 156 | 2a | 26 | 7 | 9 | A0201 | TLPSLRETL | 4568 | 10.468 |
| 157 | 2a | 26 | 14 | 10 | A1 | TLELRRPYTR | 4569 | 18 |
| 158 | 2a | 26 | 20 | 9 | A24 | PYTRLAPCL | 4570 | 24 |
| 159 | 2a | 26 | 14 | 10 | A3101 | TLELRRPYTR | 4571 | 10 |
| 160 | 2a | 26 | 10 | 10 | A3 | SLRETLELRR | 4572 | 12 |
| 161 | 2a | 26 | 14 | 10 | A3 | TLELRRPYTR | 4573 | 12 |
| 162 | 2a | 26 | 27 | 9 | A3 | CLRRPVLPY | 4574 | 36 |
| 163 | 2a | 26 | 19 | 10 | B3501 | RPYTRLAPCL | 4575 | 40 |
| 164 | 2a | 26 | 8 | 10 | B3501 | LPSLRETLEL | 4576 | 30 |
| 165 | 2a | 26 | 8 | 8 | B3501 | LPSLRETL | 4577 | 20 |
| 166 | 2a | 26 | 25 | 9 | B3501 | APCLRRPVL | 4578 | 20 |
| 167 | 2a | 26 | 8 | 10 | B7 | LPSLRETLEL | 4579 | 80 |
| 168 | 2a | 26 | 19 | 10 | B7 | RPYTRLAPCL | 4580 | 80 |
| 169 | 2a | 26 | 2 | 10 | B7 | TPDALTLPSL | 4581 | 24 |
| 170 | 2a | 26 | 24 | 10 | B7 | LAPCLRRPVL | 4582 | 18 |
| 171 | 2a | 26 | 25 | 9 | B7 | APCLRRPVL | 4583 | 360 |
| 172 | 2a | 26 | 16 | 9 | B7 | ELRRPYTRL | 4584 | 60 |
| 173 | 2a | 26 | 24 | 10 | B8 | LAPCLRRPVL | 4585 | 16 |
| 174 | 2a | 26 | 8 | 8 | B8 | LPSLRETL | 4586 | 16 |
| 175 | 2a | 26 | 10 | 8 | B8 | SLRETLEL | 4587 | 12 |
| 176 | 2a | 26 | 16 | 9 | B8 | ELRRPYTRL | 4588 | 16 |
| 177 | 2a | 26 | 25 | 9 | B8 | APCLRRPVL | 4589 | 16 |
| 178 | 2a | 27 | 3 | 10 | A0201 | WLSSQKARGL | 4590 | 19.653 |
| 179 | 2a | 28 | 2 | 10 | A0201 | CLWHSAYRAA | 4591 | 12.37 |
| 180 | 2a | 28 | 2 | 9 | A0201 | CLWHSAYRA | 4592 | 41.234 |
| 181 | 2a | 31 | 2 | 10 | B7 | APVPPRFSSL | 4593 | 240 |
| 182 | 2a | 31 | 4 | 9 | B7 | VPPRFSSLL | 4594 | 80 |
| 183 | 2a | 31 | 2 | 10 | B8 | APVPPRFSSL | 4595 | 16 |
| 184 | 2a | 32 | 14 | 10 | A24 | SYGVGHDDEL | 4596 | 220 |
| 185 | 2a | 32 | 19 | 9 | B4403 | HDDELVTHY | 4597 | 67.5 |
| 186 | 2a | 34 | 14 | 9 | A3 | VLFHPQPSR | 4598 | 30 |
| 187 | 2a | 34 | 4 | 10 | B3501 | SPREVRVRPS | 4599 | 12 |
| 188 | 2a | 34 | 7 | 9 | B7 | EVRVRPSVL | 4600 | 200 |
| 189 | 2a | 34 | 4 | 10 | B8 | SPREVRVRPS | 4601 | 12 |
| 190 | 2a | 34 | 7 | 8 | B8 | EVRVRPSV | 4602 | 24 |
| 191 | 2a | 34 | 7 | 9 | B8 | EVRVRPSVL | 4603 | 160 |
| 192 | 2a | 35 | 1 | 9 | B7 | MVRLHVDEL | 4604 | 200 |
| 193 | 2a | 36 | 14 | 9 | A0201 | RLPLQALAL | 4605 | 21.362 |
| 194 | 2a | 36 | 2 | 10 | A24 | WFWALAHAEF | 4606 | 11 |
| 195 | 2a | 36 | 14 | 9 | A24 | RLPLQALAL | 4607 | 12 |

TABLE 4e-continued 2a (1-3)

| No. | Strain | ORF | Start | AA | HLA | Peptide sequence | SEQ ID NO | Score |
|---|---|---|---|---|---|---|---|---|
| 196 | 2a | 36 | 5 | 10 | A3 | ALAHAEFPGR | 4608 | 12 |
| 197 | 2a | 36 | 11 | 10 | B3501 | FPGRLPLQAL | 4609 | 20 |
| 198 | 2a | 36 | 15 | 10 | B3501 | LPLQALALPL | 4610 | 20 |
| 199 | 2a | 36 | 15 | 8 | B3501 | LPLQALAL | 4611 | 20 |
| 200 | 2a | 36 | 11 | 10 | B7 | FPGRLPLQAL | 4612 | 120 |
| 201 | 2a | 36 | 15 | 10 | B7 | LPLQALALPL | 4613 | 80 |
| 202 | 2a | 36 | 6 | 10 | B7 | LAHAEFPGRL | 4614 | 12 |
| 203 | 2a | 37 | 6 | 10 | A0201 | LLFLRLARFV | 4615 | 481.23 |
| 204 | 2a | 37 | 10 | 10 | A0201 | RLARFVDWST | 4616 | 55.89 |
| 205 | 2a | 37 | 3 | 9 | A0205 | HLALLFLRL | 4617 | 14 |
| 206 | 2a | 37 | 17 | 9 | A1 | WSTPPPPKY | 4618 | 15 |
| 207 | 2a | 37 | 35 | 9 | A1 | VTCPYKICR | 4619 | 12.5 |
| 208 | 2a | 37 | 24 | 10 | A24 | KYRGRTIHVW | 4620 | 10 |
| 209 | 2a | 37 | 43 | 9 | A24 | RSMGVGSAL | 4621 | 16.8 |
| 210 | 2a | 37 | 24 | 9 | A24 | KYRGRTIHV | 4622 | 10 |
| 211 | 2a | 37 | 31 | 10 | A3 | HVWPVTCPYK | 4623 | 15 |
| 212 | 2a | 37 | 60 | 9 | A3 | GLRLRVDAY | 4624 | 36 |
| 213 | 2a | 37 | 6 | 9 | A3 | LLFLRLARF | 4625 | 15 |
| 214 | 2a | 37 | 5 | 9 | A3 | ALLFLRLAR | 4626 | 12 |
| 215 | 2a | 37 | 52 | 10 | B3501 | IPSPSGRQGL | 4627 | 20 |
| 216 | 2a | 37 | 54 | 10 | B3501 | SPSGRQGLRL | 4628 | 20 |
| 217 | 2a | 37 | 54 | 8 | B3501 | SPSGRQGL | 4629 | 20 |
| 218 | 2a | 37 | 37 | 9 | B3501 | CPYKICRSM | 4630 | 40 |
| 219 | 2a | 37 | 17 | 9 | B3501 | WSTPPPPKY | 4631 | 10 |
| 220 | 2a | 37 | 43 | 9 | B3501 | RSMGVGSAL | 4632 | 10 |
| 221 | 2a | 37 | 59 | 10 | B4403 | QGLRLRVDAY | 4633 | 18 |
| 222 | 2a | 37 | 78 | 9 | B4403 | REAGRLARC | 4634 | 18 |
| 223 | 2a | 37 | 52 | 10 | B7 | IPSPSGRQGL | 4635 | 120 |
| 224 | 2a | 37 | 54 | 10 | B7 | SPSGRQGLRL | 4636 | 80 |
| 225 | 2a | 37 | 60 | 10 | B7 | GLRLRVDAYL | 4637 | 40 |
| 226 | 2a | 37 | 37 | 9 | B7 | CPYKICRSM | 4638 | 20 |
| 227 | 2a | 37 | 43 | 9 | B7 | RSMGVGSAL | 4639 | 12 |
| 228 | 2a | 37 | 54 | 8 | B8 | SPSGRQGL | 4640 | 16 |
| 229 | 2a | 38 | 2 | 9 | A0201 | ALLPTAPRT | 4641 | 27.572 |
| 230 | 2a | 38 | 7 | 9 | B3501 | APRTAPTGL | 4642 | 60 |
| 231 | 2a | 38 | 7 | 10 | B7 | APRTAPTGLC | 4643 | 90 |
| 232 | 2a | 38 | 6 | 10 | B7 | TAPRTAPTGL | 4644 | 12 |
| 233 | 2a | 38 | 7 | 9 | B7 | APRTAPTGL | 4645 | 2400 |
| 234 | 2a | 38 | 7 | 9 | B8 | APRTAPTGL | 4646 | 16 |
| 235 | 2a | 40 | 12 | 10 | B3501 | RPTRSGDSPW | 4647 | 20 |
| 236 | 2a | 42 | 9 | 10 | A24 | RYHHPRHRNS | 4648 | 10 |
| 237 | 2a | 42 | 9 | 9 | A24 | RYHHPRHRN | 4649 | 10 |
| 238 | 2a | 43 | 6 | 10 | A0201 | AILGQTHVEL | 4650 | 10.868 |
| 239 | 2a | 43 | 7 | 9 | A0201 | ILGQTHVEL | 4651 | 36.316 |
| 240 | 2a | 43 | 6 | 10 | B7 | AILGQTHVEL | 4652 | 12 |
| 241 | 2a | 44 | 29 | 10 | A1 | ACDPTAWLPY | 4653 | 1250 |
| 242 | 2a | 44 | 13 | 8 | B3501 | KPRRPYPL | 4654 | 120 |
| 243 | 2a | 44 | 31 | 8 | B3501 | DPTAWLPY | 4655 | 40 |
| 244 | 2a | 44 | 31 | 9 | B3501 | DPTAWLPYY | 4656 | 40 |
| 245 | 2a | 44 | 30 | 10 | B4403 | CDPTAWLPYY | 4657 | 22.5 |
| 246 | 2a | 44 | 29 | 10 | B4403 | ACDPTAWLPY | 4658 | 18 |
| 247 | 2a | 44 | 2 | 9 | B4403 | DEQAHSLCF | 4659 | 120 |
| 248 | 2a | 44 | 30 | 9 | B4403 | CDPTAWLPY | 4660 | 22.5 |
| 249 | 2a | 44 | 31 | 9 | B4403 | DPTAWLPYY | 4661 | 13.5 |
| 250 | 2a | 44 | 27 | 10 | B7 | VAACDPTAWL | 4662 | 18 |
| 251 | 2a | 44 | 28 | 9 | B7 | AACDPTAWL | 4663 | 54 |
| 252 | 2a | 45 | 1 | 9 | A0201 | MLCEGPSGL | 4664 | 148.896 |
| 253 | 2a | 46 | 12 | 10 | A0201 | YMGPHGPDDT | 4665 | 12.131 |
| 254 | 2a | 46 | 14 | 10 | B3501 | GPHGPDDTFF | 4666 | 30 |
| 255 | 2a | 46 | 6 | 8 | B3501 | HPVCSNYM | 4667 | 40 |
| 256 | 2a | 46 | 17 | 8 | B3501 | GPDDTFFL | 4668 | 12 |
| 257 | 2a | 46 | 14 | 9 | B3501 | GPHGPDDTF | 4669 | 20 |
| 258 | 2a | 47 | 2 | 10 | B7 | SVVQPPGPPL | 4670 | 30 |
| 259 | 2a | 47 | 3 | 9 | B7 | VVQPPGPPL | 4671 | 30 |

TABLE 4f 2a (4-6)

| No. | Strain | ORF | Start | AA | HLA | Peptide sequence | SEQ ID NO | Score |
|---|---|---|---|---|---|---|---|---|
| 1 | HCV 2a | 1 | 10 | 9 | A_0201 | YSWSILDDV | 4672 | 19.536 |
| 2 | HCV 2a | 2 | 8 | 10 | A_0201 | RLLQgEELCA | 4673 | 18.382 |
| 3 | HCV 2a | 2 | 10 | 10 | A_0201 | LQGEeLCADL | 4674 | 15.096 |
| 4 | HCV 2a | 2 | 6 | 10 | B7 | LARLLQGEEL | 4675 | 120.000 |
| 5 | HCV 2a | 2 | 6 | 10 | B8 | LARLLQGEEL | 4676 | 16.000 |
| 6 | HCV 2a | 3 | | | | no hits | | |
| 7 | HCV 2a | 4 | 12 | 9 | A_0201 | KGYEPVHPL | 4677 | 14.728 |
| 8 | HCV 2a | 4 | 56 | 9 | A3 | VLHGGLLAR | 4678 | 18.000 |
| 9 | HCV 2a | 4 | 48 | 9 | B7 | NPRQQIDDV | 4679 | 40.000 |
| 10 | HCV 2a | 4 | 48 | 9 | B_3501 | NPRQQIDDV | 4680 | 12.000 |
| 11 | HCV 2a | 4 | 70 | 9 | B_4403 | DEGPRNARA | 4681 | 24.000 |
| 12 | HCV 2a | 4 | 13 | 10 | A1 | GYEPvHPLDR | 4682 | 22.500 |
| 13 | HCV 2a | 4 | 60 | 10 | A_0201 | GLLArHDLEC | 4683 | 18.382 |
| 14 | HCV 2a | 4 | 79 | 10 | B7 | IPRQdIHQHL | 4684 | 800.000 |
| 15 | HCV 2a | 4 | 48 | 10 | B7 | NPRQqIDDVL | 4685 | 800.000 |
| 16 | HCV 2a | 4 | 75 | 10 | B7 | NARAiPRQDI | 4686 | 27.000 |
| 17 | HCV 2a | 4 | 79 | 10 | B8 | IPRQdIHQHL | 4687 | 16.000 |
| 18 | HCV 2a | 4 | 48 | 10 | B8 | NPRQqIDDVL | 4688 | 16.000 |
| 19 | HCV 2a | 4 | 79 | 10 | B_3501 | IPRQdIHQHL | 4689 | 60.000 |
| 20 | HCV 2a | 4 | 48 | 10 | B_3501 | NPRQqIDDVL | 4690 | 60.000 |
| 21 | HCV 2a | 4 | 15 | 10 | B_3501 | EPVHpLDRAF | 4691 | 20.000 |
| 22 | HCV 2a | 4 | 70 | 10 | B_4403 | DEGPrNARAI | 4692 | 36.000 |
| 23 | HCV 2a | 5 | 6 | 9 | A_0201 | LVGNRAQTV | 4693 | 10.346 |
| 24 | HCV 2a | 6 | 10 | 9 | A1 | RVEIRSKPY | 4694 | 45.000 |
| 25 | HCV 2a | 6 | 36 | 9 | A1 | LTEHHAIKH | 4695 | 11.250 |
| 26 | HCV 2a | 6 | 25 | 9 | A_0201 | KLIPRSPCV | 4696 | 243.432 |
| 27 | HCV 2a | 6 | 35 | 9 | A3 | ALTEHHAIK | 4697 | 30.000 |
| 28 | HCV 2a | 6 | 27 | 9 | B7 | IPRSPCVVA | 4698 | 30.000 |
| 29 | HCV 2a | 6 | 25 | 10 | A_0201 | KLIPrSPCVV | 4699 | 99.807 |
| 30 | HCV 2a | 6 | 2 | 10 | A_0201 | VLAHgQARRV | 4700 | 23.648 |
| 31 | HCV 2a | 6 | 17 | 10 | A24 | PYGSlRWRKL | 4701 | 22.000 |
| 32 | HCV 2a | 6 | 16 | 10 | A3 | KPYGsLRWRK | 4702 | 13.500 |
| 33 | HCV 2a | 6 | 20 | 10 | A3 | SLRWrKLIPR | 4703 | 12.000 |
| 34 | HCV 2a | 6 | 27 | 10 | B7 | IPRSpCVVAL | 4704 | 800.000 |
| 35 | HCV 2a | 6 | 12 | 10 | B7 | EIRSkPYGSL | 4705 | 60.000 |
| 36 | HCV 2a | 6 | 27 | 10 | B8 | IPRSpCVVAL | 4706 | 16.000 |
| 37 | HCV 2a | 6 | 27 | 10 | B_3501 | IPRSpCVVAL | 4707 | 60.000 |
| 38 | HCV 2a | 6 | 14 | 10 | B_3501 | RSKPyGSLRW | 4708 | 15.000 |
| 39 | HCV 2a | 6 | 11 | 10 | B_4403 | VEIRsKPYGS | 4709 | 30.000 |
| 40 | HCV 2a | 7 | 25 | 9 | A_0201 | TLLPEGHLL | 4710 | 79.041 |
| 41 | HCV 2a | 7 | 26 | 9 | A3 | LLPEGHLLY | 4711 | 12.000 |
| 42 | HCV 2a | 7 | 18 | 9 | B7 | SPIEGDLTL | 4712 | 80.000 |
| 43 | HCV 2a | 7 | 18 | 9 | B_3501 | SPIEGDLTL | 4713 | 40.000 |
| 44 | HCV 2a | 7 | 2 | 9 | B_4403 | AEDQVSPSL | 4714 | 12.000 |
| 45 | HCV 2a | 7 | 25 | 10 | A1 | TLLPeGHLLY | 4715 | 25.000 |
| 46 | HCV 2a | 7 | 26 | 10 | A_0201 | LLPEgHLLYI | 4716 | 919.865 |
| 47 | HCV 2a | 7 | 17 | 10 | A24 | RSPIeGDLTL | 4717 | 12.000 |
| 48 | HCV 2a | 7 | 1 | 10 | A24 | MAEDqVSPSL | 4718 | 10.080 |
| 49 | HCV 2a | 7 | 25 | 10 | A3 | TLLPeGHLLY | 4719 | 18.000 |
| 50 | HCV 2a | 7 | 18 | 10 | B7 | SPIEgDLTLL | 4720 | 80.000 |
| 51 | HCV 2a | 7 | 11 | 10 | B7 | DVRQgKRSPI | 4721 | 30.000 |
| 52 | HCV 2a | 7 | 11 | 10 | B8 | DVRQgKRSPI | 4722 | 40.000 |
| 53 | HCV 2a | 7 | 42 | 10 | B_3501 | RPRGsGRGQY | 4723 | 240.000 |
| 54 | HCV 2a | 7 | 18 | 10 | B_3501 | SPIEgDLTLL | 4724 | 60.000 |
| 55 | HCV 2a | 7 | 17 | 10 | B_3501 | RSPIeGDLTL | 4725 | 10.000 |
| 56 | HCV 2a | 8 | 9 | 10 | B_3501 | KPQGgSHRGI | 4726 | 16.000 |
| 57 | HCV 2a | 9 | 8 | 9 | A_0201 | GLGHSWWCA | 4727 | 63.342 |
| 58 | HCV 2a | 9 | 23 | 9 | B_3501 | RPRDDVECF | 4728 | 360.000 |
| 59 | HCV 2a | 9 | 34 | 9 | B_4403 | DEVYGLSHA | 4729 | 36.000 |
| 60 | HCV 2a | 9 | 8 | 10 | A_0201 | GLGHsWWCAV | 4730 | 118.238 |
| 61 | HCV 2a | 9 | 6 | 10 | A_0201 | LVGLgHSWWC | 4731 | 30.483 |
| 62 | HCV 2a | 9 | 30 | 10 | A24 | CFNGdEVYGL | 4732 | 30.000 |
| 63 | HCV 2a | 9 | 23 | 10 | B_3501 | RPRDdVECFN | 4733 | 24.000 |
| 64 | HCV 2a | 9 | 28 | 10 | B_4403 | VECFnGDEVY | 4734 | 120.000 |
| 65 | HCV 2a | 10 | 22 | 9 | B7 | AARWRATSL | 4735 | 360.000 |
| 66 | HCV 2a | 10 | 22 | 9 | B8 | AARWRATSL | 4736 | 320.000 |
| 67 | HCV 2a | 10 | 15 | 10 | A1 | GIEVgSNAAR | 4737 | 18.000 |
| 68 | HCV 2a | 10 | 21 | 10 | B7 | NAARwRATSL | 4738 | 12.000 |
| 69 | HCV 2a | 10 | 21 | 10 | B8 | NAARwRATSL | 4739 | 16.000 |
| 70 | HCV 2a | 10 | 16 | 10 | B_4403 | IEVGsNAARW | 4740 | 54.000 |
| 71 | HCV 2a | 11 | 45 | 9 | A24 | STNDVYDDL | 4741 | 10.080 |
| 72 | HCV 2a | 11 | 26 | 9 | B7 | GPRSLHREV | 4742 | 40.000 |
| 73 | HCV 2a | 11 | 41 | 9 | B7 | APMSSTNDV | 4743 | 36.000 |
| 74 | HCV 2a | 11 | 26 | 9 | B_3501 | GPRSLHREV | 4744 | 12.000 |
| 75 | HCV 2a | 11 | 37 | 9 | B_4403 | AEHNAPMSS | 4745 | 12.000 |

TABLE 4f-continued

2a (4-6)

| No. Strain | ORF | Start | AA | HLA | Peptide sequence | SEQ ID NO | Score |
|---|---|---|---|---|---|---|---|
| 76 HCV 2a | 11 | 41 | 10 | B_3501 | APMSsTNDVY | 4746 | 40.000 |
| 77 HCV 2a | 11 | 32 | 10 | B_4403 | REVGqAEHNA | 4747 | 18.000 |
| 78 HCV 2a | 11 | 41 | 10 | B_4403 | APMSsTNDVY | 4748 | 12.000 |
| 79 HCV 2a | 12 | 13 | 9 | A24 | AFLHKPVVL | 4749 | 30.000 |
| 80 HCV 2a | 12 | 14 | 9 | A3 | FLHKPVVLR | 4750 | 18.000 |
| 81 HCV 2a | 12 | 60 | 9 | B7 | ALREGAALL | 4751 | 120.000 |
| 82 HCV 2a | 12 | 20 | 9 | B7 | VLRRDNEHL | 4752 | 40.000 |
| 83 HCV 2a | 12 | 59 | 9 | B7 | QALREGAAL | 4753 | 12.000 |
| 84 HCV 2a | 12 | 60 | 9 | B8 | ALREGAALL | 4754 | 12.000 |
| 85 HCV 2a | 12 | 25 | 9 | B_4403 | NEHLGCQHY | 4755 | 120.000 |
| 86 HCV 2a | 12 | 24 | 10 | A1 | DNEHlGCQHY | 4756 | 11.250 |
| 87 HCV 2a | 12 | 53 | 10 | A1 | HVDVrPQALR | 4757 | 10.000 |
| 88 HCV 2a | 12 | 6 | 10 | A_0201 | TQVDgAIAFL | 4758 | 112.335 |
| 89 HCV 2a | 12 | 14 | 10 | A3 | FLHKpVVLRR | 4759 | 36.000 |
| 90 HCV 2a | 12 | 19 | 10 | B7 | VVLRrDNEHL | 4760 | 20.000 |
| 91 HCV 2a | 12 | 12 | 10 | B7 | IAFLhKPVVL | 4761 | 12.000 |
| 92 HCV 2a | 12 | 59 | 10 | B7 | QALReGAALL | 4762 | 12.000 |
| 93 HCV 2a | 12 | 12 | 10 | B8 | IAFLhKPVVL | 4763 | 16.000 |
| 94 HCV 2a | 12 | 36 | 10 | B_4403 | AEVPhVESRA | 4764 | 48.000 |
| 95 HCV 2a | 13 | | | | no hits | | |
| 96 HCV 2a | 14 | 18 | 9 | B7 | EPSCPAESL | 4765 | 120.000 |
| 97 HCV 2a | 14 | 18 | 9 | B_3501 | EPSCPAESL | 4766 | 20.000 |
| 98 HCV 2a | 15 | 7 | 9 | A_0201 | RQARVTFQL | 4767 | 12.562 |
| 99 HCV 2a | 15 | 7 | 9 | A24 | RQARVtFQL | 4768 | 11.200 |
| 100 HCV 2a | 15 | 8 | 10 | B7 | QARVtFQLWL | 4769 | 120.000 |
| 101 HCV 2a | 15 | 8 | 10 | B8 | QARVtFQLWL | 4770 | 16.000 |
| 102 HCV 2a | 15 | 22 | 10 | B_3501 | DSRStPIRTF | 4771 | 15.000 |
| 103 HCV 2a | 15 | 3 | 10 | B_4403 | AEGRrQARVT | 4772 | 12.000 |
| 104 HCV 2a | 16 | 1 | 10 | A_0201 | MLSApGHIPV | 4773 | 118.238 |
| 105 HCV 2a | 17 | 19 | 10 | B_3501 | MPPSlPEEAF | 4774 | 20.000 |
| 106 HCV 2a | 17 | 4 | 10 | B_4403 | RETPpAGRGS | 4775 | 12.000 |
| 107 HCV 2a | 18 | | | | no hits | | |
| 108 HCV 2a | 19 | 16 | 9 | B_4403 | RESPERPLW | 4776 | 24.000 |
| 109 HCV 2a | 19 | 2 | 10 | A_0201 | VLRArGRSFL | 4777 | 15.180 |
| 110 HCV 2a | 19 | 14 | 10 | B7 | SGREsPERPL | 4778 | 60.000 |
| 111 HCV 2a | 19 | 2 | 10 | B7 | VLRArGRSFL | 4779 | 60.000 |
| 112 HCV 2a | 20 | 6 | 9 | B_3501 | GSPRSLPQM | 4780 | 10.000 |
| 113 HCV 2a | 20 | 10 | 10 | A_0201 | SLPQmGVTPA | 4781 | 11.426 |
| 114 HCV 2a | 20 | 2 | 10 | B7 | APIAgSPRSL | 4782 | 240.000 |
| 115 HCV 2a | 20 | 11 | 10 | B7 | LPQMgVTPAL | 4783 | 80.000 |
| 116 HCV 2a | 20 | 7 | 10 | B7 | SPRSlPQMGV | 4784 | 60.000 |
| 117 HCV 2a | 20 | 15 | 10 | B7 | GVTPaLSAAL | 4785 | 20.000 |
| 118 HCV 2a | 20 | 2 | 10 | B_3501 | APIAgSPRSL | 4786 | 20.000 |
| 119 HCV 2a | 20 | 11 | 10 | B_3501 | LPQMgVTPAL | 4787 | 20.000 |
| 120 HCV 2a | 20 | 7 | 10 | B_3501 | SPRSlPQMGV | 4788 | 12.000 |
| 121 HCV 2a | 21 | | | | no hits | | |
| 122 HCV 2a | 22 | 19 | 9 | B7 | APCPGLCCL | 4789 | 240.000 |
| 123 HCV 2a | 22 | 16 | 9 | B7 | YPPAPCPGL | 4790 | 120.000 |
| 124 HCV 2a | 22 | 8 | 9 | B_3501 | CPRHTPPGY | 4791 | 120.000 |
| 125 HCV 2a | 22 | 16 | 9 | B_3501 | YPPAPCPGL | 4792 | 20.000 |
| 126 HCV 2a | 22 | 19 | 9 | B_3501 | APCPGLCCL | 4793 | 20.000 |
| 127 HCV 2a | 22 | 23 | 10 | A_0201 | GLCCLQQPPL | 4794 | 21.362 |
| 128 HCV 2a | 22 | 15 | 10 | A24 | GYPPaPCPGL | 4795 | 360.000 |
| 129 HCV 2a | 23 | 5 | 9 | B_3501 | KPQQDSLVV | 4796 | 12.000 |
| 130 HCV 2a | 23 | 5 | 10 | A24 | KPQQdSLVVL | 4797 | 12.000 |
| 131 HCV 2a | 23 | 5 | 10 | B7 | KPQQdSLVVL | 4798 | 80.000 |
| 132 HCV 2a | 23 | 5 | 10 | B_3501 | KPQQdSLVVL | 4799 | 40.000 |
| 133 HCV 2a | 24 | | | | no hits | | |
| 134 HCV 2a | 25 | 5 | 10 | B7 | LPRPpQLGPT | 4800 | 20.000 |
| 135 HCV 2a | 25 | 7 | 10 | B_3501 | RPPQLGPTCW | 4801 | 20.000 |
| 136 HCV 2a | 26 | | | | no hits | | |
| 137 HCV 2a | 27 | 9 | 9 | A24 | LFGKGSGHL | 4802 | 20.000 |
| 138 HCV 2a | 27 | 3 | 10 | A1 | NSPPIALFGK | 4803 | 15.000 |
| 139 HCV 2a | 27 | 8 | 10 | A_0201 | ALFGkGSGHL | 4804 | 10.275 |
| 140 HCV 2a | 27 | 8 | 10 | B7 | ALFGkGSGHL | 4805 | 12.000 |
| 141 HCV 2a | 28 | 20 | 9 | A_0201 | SLNGRRSSV | 4806 | 69.552 |
| 142 HCV 2a | 28 | 22 | 9 | B7 | NGRRSSVSL | 4807 | 40.000 |
| 143 HCV 2a | 28 | 11 | 9 | B_3501 | GPPRAHHTF | 4808 | 20.000 |
| 144 HCV 2a | 28 | 12 | 10 | B7 | PPRAhHTFSL | 4809 | 80.000 |
| 145 HCV 2a | 29 | 4 | 10 | A3 | TLWPpRSSQF | 4810 | 15.000 |
| 146 HCV 2a | 30 | | | | no hits | | |
| 147 HCV 2a | 31 | 10 | 10 | B7 | AVRGaVGKRA | 4811 | 15.000 |
| 148 HCV 2a | 32 | 28 | 9 | A24 | VYRSCPPRL | 4812 | 200.000 |
| 149 HCV 2a | 32 | 18 | 9 | B7 | SPPTCKWAL | 4813 | 80.000 |
| 150 HCV 2a | 32 | 18 | 9 | B_3501 | SPPTCKWAL | 4814 | 20.000 |

TABLE 4f-continued 2a (4-6)

| No. Strain | ORF | Start | AA | HLA | Peptide sequence | SEQ ID NO | Score |
|---|---|---|---|---|---|---|---|
| 151 HCV 2a | 32 | 14 | 10 | A3 | HLSHsPPTCK | 4815 | 30.000 |
| 152 HCV 2a | 32 | 27 | 10 | B7 | QVYRsCPPRL | 4816 | 20.000 |
| 153 HCV 2a | 33 | | | | no hits | | |
| 154 HCV 2a | 34 | | | | no hits | | |
| 155 HCV 2a | 35 | 8 | 9 | A1 | GLEAVRHSY | 4817 | 45.000 |
| 156 HCV 2a | 35 | 8 | 9 | A3 | GLEAVRHSY | 4818 | 18.000 |
| 157 HCV 2a | 35 | 1 | 9 | B7 | MALPGGGGL | 4819 | 12.000 |
| 158 HCV 2a | 36 | 83 | 9 | A1 | RSEVFLVVR | 4820 | 27.000 |
| 159 HCV 2a | 36 | 121 | 9 | A_0201 | RLVFLLVFL | 4821 | 270.234 |
| 160 HCV 2a | 36 | 87 | 9 | A_0201 | FLVVRTPNL | 4822 | 98.267 |
| 161 HCV 2a | 36 | 56 | 9 | A24 | GYPGFPQDL | 4823 | 360.000 |
| 162 HCV 2a | 36 | 121 | 9 | A24 | RLVFLLVFL | 4824 | 14.400 |
| 163 HCV 2a | 36 | 69 | 9 | A24 | RSLGMGWRL | 4825 | 12.000 |
| 164 HCV 2a | 36 | 118 | 9 | B7 | CGRRLVFLL | 4826 | 40.000 |
| 165 HCV 2a | 36 | 12 | 9 | B7 | RVSMTLPTL | 4827 | 20.000 |
| 166 HCV 2a | 36 | 117 | 9 | B8 | SCGRRLVFL | 4828 | 16.000 |
| 167 HCV 2a | 36 | 42 | 9 | B_3501 | HPAQPSPSF | 4829 | 20.000 |
| 168 HCV 2a | 36 | 69 | 9 | B_3501 | RSLGMGWRL | 4830 | 10.000 |
| 169 HCV 2a | 36 | 84 | 9 | B_4403 | SEVFLVVRT | 4831 | 48.000 |
| 170 HCV 2a | 36 | 79 | 10 | A_0201 | RGWDrSEVFL | 4832 | 26.100 |
| 171 HCV 2a | 36 | 114 | 10 | A_0201 | NLTScGRRLV | 4833 | 13.910 |
| 172 HCV 2a | 36 | 86 | 10 | A24 | VFLVvRTPNL | 4834 | 30.000 |
| 173 HCV 2a | 36 | 8 | 10 | A24 | KPHVrVSMTL | 4835 | 11.200 |
| 174 HCV 2a | 36 | 51 | 10 | A24 | PYRGqGYPGF | 4836 | 10.000 |
| 175 HCV 2a | 36 | 70 | 10 | A3 | SLGMgWRLPR | 4837 | 24.000 |
| 176 HCV 2a | 36 | 89 | 10 | B7 | VVRTpNLGPL | 4838 | 200.000 |
| 177 HCV 2a | 36 | 8 | 10 | B7 | KPHVrVSMTL | 4839 | 80.000 |
| 178 HCV 2a | 36 | 77 | 10 | B7 | LPRGwDRSEV | 4840 | 60.000 |
| 179 HCV 2a | 36 | 19 | 10 | B7 | TLRDlCRGSL | 4841 | 60.000 |
| 180 HCV 2a | 36 | 64 | 10 | B7 | LPVErRSLGM | 4842 | 20.000 |
| 181 HCV 2a | 36 | 35 | 10 | B7 | EPRGdRSHPA | 4843 | 20.000 |
| 182 HCV 2a | 36 | 35 | 10 | B8 | EPRGdRSHPA | 4844 | 32.000 |
| 183 HCV 2a | 36 | 19 | 10 | B8 | TLRDlCRGSL | 4845 | 12.000 |
| 184 HCV 2a | 36 | 64 | 10 | B_3501 | LPVErRSLGM | 4846 | 80.000 |
| 185 HCV 2a | 36 | 8 | 10 | B_3501 | KPHVrVSMTL | 4847 | 40.000 |
| 186 HCV 2a | 36 | 6 | 10 | B_3501 | SAKPhVRVSM | 4848 | 18.000 |
| 187 HCV 2a | 36 | 77 | 10 | B_3501 | LPRGwDRSEV | 4849 | 18.000 |
| 188 HCV 2a | 36 | 66 | 10 | B_4403 | VERRsLGMGW | 4850 | 12.000 |
| 189 HCV 2a | 37 | 109 | 9 | A1 | YTDPYISKL | 4851 | 12.500 |
| 190 HCV 2a | 37 | 147 | 9 | A_0201 | WMMFPNHEL | 4852 | 262.591 |
| 191 HCV 2a | 37 | 77 | 9 | A_0201 | RVSSWGVYV | 4853 | 33.472 |
| 192 HCV 2a | 37 | 70 | 9 | A_0201 | FLRAEATRV | 4854 | 24.315 |
| 193 HCV 2a | 37 | 148 | 9 | A_0201 | MMFPNHELT | 4855 | 16.588 |
| 194 HCV 2a | 37 | 36 | 9 | A24 | RYRPQTAAL | 4856 | 480.000 |
| 195 HCV 2a | 37 | 167 | 9 | A24 | RAIGVVGSL | 4857 | 16.800 |
| 196 HCV 2a | 37 | 105 | 9 | A3 | GLTEYTDPY | 4858 | 54.000 |
| 197 HCV 2a | 37 | 27 | 9 | A3 | SLVFTAQLK | 4859 | 30.000 |
| 198 HCV 2a | 37 | 45 | 9 | B7 | PPREMRDAL | 4860 | 120.000 |
| 199 HCV 2a | 37 | 147 | 9 | B7 | WMMFPNHEL | 4861 | 18.000 |
| 200 HCV 2a | 37 | 51 | 9 | B7 | DALTARARL | 4862 | 18.000 |
| 201 HCV 2a | 37 | 167 | 9 | B7 | RAIGVVGSL | 4863 | 12.000 |
| 202 HCV 2a | 37 | 18 | 9 | B7 | RASGNGVSL | 4864 | 12.000 |
| 203 HCV 2a | 37 | 54 | 9 | B8 | TARARLFHA | 4865 | 16.000 |
| 204 HCV 2a | 37 | 45 | 9 | B_3501 | PPREMRDAL | 4866 | 12.000 |
| 205 HCV 2a | 37 | 91 | 9 | B_3501 | SSPCNLSIM | 4867 | 10.000 |
| 206 HCV 2a | 37 | 73 | 9 | B_4403 | AEATRVSSW | 4868 | 144.000 |
| 207 HCV 2a | 37 | 129 | 9 | B_4403 | MEKKCVIRT | 4869 | 12.000 |
| 208 HCV 2a | 37 | 47 | 9 | B_4403 | REMRDALTA | 4870 | 12.000 |
| 209 HCV 2a | 37 | 157 | 9 | B_4403 | GECLTVSQA | 4871 | 12.000 |
| 210 HCV 2a | 37 | 109 | 10 | A1 | YTDPyISKLR | 4872 | 125.000 |
| 211 HCV 2a | 37 | 105 | 10 | A_0201 | GLTEyTDPYI | 4873 | 235.260 |
| 212 HCV 2a | 37 | 25 | 10 | A_0201 | SLSLvFTAQL | 4874 | 81.177 |
| 213 HCV 2a | 37 | 147 | 10 | A_0201 | WMMFpNHELT | 4875 | 44.885 |
| 214 HCV 2a | 37 | 108 | 10 | A24 | EYTDpYISKL | 4876 | 264.000 |
| 215 HCV 2a | 37 | 27 | 10 | A3 | SLVFtAQLKR | 4877 | 12.000 |
| 216 HCV 2a | 37 | 62 | 10 | B7 | ALRGgAPSFL | 4878 | 120.000 |
| 217 HCV 2a | 37 | 44 | 10 | B7 | LPPReMRDAL | 4879 | 120.000 |
| 218 HCV 2a | 37 | 54 | 10 | B7 | TARArLFHAL | 4880 | 120.000 |
| 219 HCV 2a | 37 | 126 | 10 | B7 | AIRMeKKCVI | 4881 | 12.000 |
| 220 HCV 2a | 37 | 19 | 10 | B7 | ASGNgVSLSL | 4882 | 12.000 |
| 221 HCV 2a | 37 | 97 | 10 | B7 | SIMAgRSRGL | 4883 | 12.000 |
| 222 HCV 2a | 37 | 120 | 10 | B7 | WSRVsWAIRM | 4884 | 10.000 |
| 223 HCV 2a | 37 | 126 | 10 | B8 | AIRMeKKCVI | 4885 | 20.000 |
| 224 HCV 2a | 37 | 54 | 10 | B8 | TARArLFHAL | 4886 | 16.000 |
| 225 HCV 2a | 37 | 134 | 10 | B8 | VIRTmRTHIV | 4887 | 12.000 |

TABLE 4f-continued 2a (4-6)

| No. | Strain | ORF | Start | AA | HLA | Peptide sequence | SEQ ID NO | Score |
|---|---|---|---|---|---|---|---|---|
| 226 | HCV 2a | 37 | 120 | 10 | B_3501 | WSRVsWAIRM | 4888 | 30.000 |
| 227 | HCV 2a | 37 | 44 | 10 | B_3501 | LPPReMRDAL | 4889 | 20.000 |
| 228 | HCV 2a | 37 | 90 | 10 | B_3501 | ASSPcNLSIM | 4890 | 10.000 |
| 229 | HCV 2a | 37 | 111 | 10 | B_3501 | DPYIsKLRSW | 4891 | 10.000 |
| 230 | HCV 2a | 37 | 100 | 10 | B_4403 | AGRSrGLTEY | 4892 | 13.500 |
| 231 | HCV 2a | 38 | 19 | 9 | A_0201 | ALQAARAFT | 4893 | 40.986 |
| 232 | HCV 2a | 38 | 11 | 10 | B7 | IVGAtIPAAL | 4894 | 20.000 |
| 233 | HCV 2a | 39 | 16 | 9 | A_0201 | RLYPQVWPL | 4895 | 1.179.204 |
| 234 | HCV 2a | 39 | 24 | 9 | A_0201 | LLLNIGPPT | 4896 | 46.873 |
| 235 | HCV 2a | 39 | 20 | 9 | A_0201 | QVWPLLLNI | 4897 | 17.427 |
| 236 | HCV 2a | 39 | 17 | 9 | A24 | LYPQVWPLL | 4898 | 420.000 |
| 237 | HCV 2a | 39 | 16 | 9 | A3 | RLYPQVWPL | 4899 | 40.500 |
| 238 | HCV 2a | 39 | 18 | 9 | B7 | YPQVWPLLL | 4900 | 80.000 |
| 239 | HCV 2a | 39 | 10 | 9 | B_3501 | TPLARQRLY | 4901 | 40.000 |
| 240 | HCV 2a | 39 | 18 | 9 | B_3501 | YPQVWPLLL | 4902 | 20.000 |
| 241 | HCV 2a | 39 | 16 | 10 | A_0201 | RLYPqVWPLL | 4903 | 116.211 |
| 242 | HCV 2a | 39 | 17 | 10 | A24 | LYPQvWPLLL | 4904 | 300.000 |
| 243 | HCV 2a | 39 | 16 | 10 | A24 | RLYPqVWPLL | 4905 | 13.440 |
| 244 | HCV 2a | 39 | 5 | 10 | A3 | MLVVsTPLAR | 4906 | 12.000 |
| 245 | HCV 2a | 39 | 3 | 10 | B7 | FPMLvVSTPL | 4907 | 240.000 |
| 246 | HCV 2a | 39 | 3 | 10 | B_3501 | FPMLvVSTPL | 4908 | 20.000 |
| 247 | HCV 2a | 40 | 19 | 9 | A_0201 | VLMSLSVTV | 4909 | 437.482 |
| 248 | HCV 2a | 40 | 34 | 9 | A24 | SYEKPIGSF | 4910 | 150.000 |
| 249 | HCV 2a | 40 | 13 | 9 | A24 | WYMASSVLM | 4911 | 37.500 |
| 250 | HCV 2a | 40 | 22 | 9 | A3 | SLSVTVESK | 4912 | 60.000 |
| 251 | HCV 2a | 40 | 42 | 9 | A3 | FLSAHAFKR | 4913 | 12.000 |
| 252 | HCV 2a | 40 | 15 | 9 | B7 | MASSVLMSL | 4914 | 12.000 |
| 253 | HCV 2a | 40 | 6 | 9 | B_3501 | SSGKEQAWY | 4915 | 15.000 |
| 254 | HCV 2a | 40 | 7 | 9 | B_3501 | SGKEQAWYM | 4916 | 12.000 |
| 255 | HCV 2a | 40 | 51 | 9 | B_3501 | NSTRWAGEY | 4917 | 10.000 |
| 256 | HCV 2a | 40 | 22 | 9 | B_4403 | VESKHRVSY | 4918 | 120.000 |
| 257 | HCV 2a | 40 | 26 | 10 | A1 | TVESkHRVSY | 4919 | 90.000 |
| 258 | HCV 2a | 40 | 14 | 10 | A_0201 | YMASsVLMSL | 4920 | 163.232 |
| 259 | HCV 2a | 40 | 18 | 10 | A_0201 | SVLMsLSVTV | 4921 | 22.517 |
| 260 | HCV 2a | 40 | 34 | 10 | A24 | SYEKpIGSFL | 4922 | 420.000 |
| 261 | HCV 2a | 40 | 11 | 10 | B7 | QAWYmASSVL | 4923 | 12.000 |
| 262 | HCV 2a | 40 | 5 | 10 | B_3501 | ASSGkEQAWY | 4924 | 15.000 |
| 263 | HCV 2a | 40 | 6 | 10 | B_3501 | SSGKeQAWYM | 4925 | 10.000 |
| 264 | HCV 2a | 40 | 33 | 10 | B_3501 | VSYEkPIGSF | 4926 | 10.000 |
| 265 | HCV 2a | 40 | 35 | 10 | B_4403 | YEKPIGSFLS | 4927 | 12.000 |
| 266 | HCV 2a | 41 | 22 | 9 | A_0201 | WLTALPDKL | 4928 | 48.151 |
| 267 | HCV 2a | 41 | 60 | 9 | A_0201 | ALTLEAASL | 4929 | 21.362 |
| 268 | HCV 2a | 41 | 15 | 9 | A24 | SFHTDLMWL | 4930 | 20.000 |
| 269 | HCV 2a | 41 | 29 | 9 | A3 | KLRTSLAPY | 4931 | 18.000 |
| 270 | HCV 2a | 41 | 55 | 9 | B7 | KVRSFALTL | 4932 | 200.000 |
| 271 | HCV 2a | 41 | 26 | 9 | B7 | LPDKLRTSL | 4933 | 36.000 |
| 272 | HCV 2a | 41 | 34 | 9 | B7 | LAPYPYLDL | 4934 | 18.000 |
| 273 | HCV 2a | 41 | 60 | 9 | B7 | ALTLEAASL | 4935 | 12.000 |
| 274 | HCV 2a | 41 | 53 | 9 | B8 | SSKVRSFAL | 4936 | 80.000 |
| 275 | HCV 2a | 41 | 53 | 9 | B_3501 | SSKVRSFAL | 4937 | 15.000 |
| 276 | HCV 2a | 41 | 37 | 9 | B_3501 | YPYLDLAEW | 4938 | 15.000 |
| 277 | HCV 2a | 41 | 29 | 9 | B_3501 | KLRTSLAPY | 4939 | 12.000 |
| 278 | HCV 2a | 41 | 63 | 9 | B_4403 | LEAASLMSF | 4940 | 120.000 |
| 279 | HCV 2a | 41 | 62 | 10 | A1 | TLEAaSLMSF | 4941 | 45.000 |
| 280 | HCV 2a | 41 | 25 | 10 | A_0201 | ALPDkLRTSL | 4942 | 87.586 |
| 281 | HCV 2a | 41 | 33 | 10 | A_0201 | SLAPyPYLDL | 4943 | 32.044 |
| 282 | HCV 2a | 41 | 39 | 10 | A_0201 | YLDLaEWGGV | 4944 | 28.283 |
| 283 | HCV 2a | 41 | 20 | 10 | A3 | LMWLtALPDK | 4945 | 150.000 |
| 284 | HCV 2a | 41 | 11 | 10 | B7 | SSRRsFHTDL | 4946 | 40.000 |
| 285 | HCV 2a | 41 | 25 | 10 | B7 | ALPDkLRTSL | 4947 | 18.000 |
| 286 | HCV 2a | 41 | 59 | 10 | B7 | FALTlEAASL | 4948 | 12.000 |
| 287 | HCV 2a | 41 | 52 | 10 | B7 | ASSKvRSFAL | 4949 | 12.000 |
| 288 | HCV 2a | 41 | 14 | 10 | B_3501 | RSFHtDLMWL | 4950 | 15.000 |
| 289 | HCV 2a | 41 | 11 | 10 | B_3501 | SSRRsFHTDL | 4951 | 15.000 |
| 290 | HCV 2a | 41 | 43 | 10 | B_4403 | AEWGgVNWHA | 4952 | 18.000 |
| 291 | HCV 2a | 42 | 115 | 9 | A_0201 | RLLGGGVGV | 4953 | 257.342 |
| 292 | HCV 2a | 42 | 94 | 9 | A_0201 | VLMASCWRA | 4954 | 234.365 |
| 293 | HCV 2a | 42 | 105 | 9 | A_0201 | MVLSLRPTV | 4955 | 38.280 |
| 294 | HCV 2a | 42 | 108 | 9 | B7 | SLRPTVRRL | 4956 | 40.000 |
| 295 | HCV 2a | 42 | 21 | 9 | B_3501 | EPGAASPPW | 4957 | 10.000 |
| 296 | HCV 2a | 42 | 97 | 9 | B_3501 | ASCWRASPM | 4958 | 10.000 |
| 297 | HCV 2a | 42 | 29 | 9 | B_4403 | WEGGRSSTW | 4959 | 18.000 |
| 298 | HCV 2a | 42 | 116 | 10 | A_0201 | LLGGgVGVFL | 4960 | 199.738 |
| 299 | HCV 2a | 42 | 93 | 10 | A_0201 | KVLMaSCWRA | 4961 | 42.220 |
| 300 | HCV 2a | 42 | 124 | 10 | A_0201 | FLGGgRAQPA | 4962 | 22.853 |

TABLE 4f-continued

2a (4-6)

| No. | Strain | ORF | Start | AA | HLA | Peptide sequence | SEQ ID NO | Score |
|---|---|---|---|---|---|---|---|---|
| 301 | HCV 2a | 42 | 78 | 10 | B7 | APVErPESPL | 4963 | 360.000 |
| 302 | HCV 2a | 42 | 108 | 10 | B7 | SLRPtVRRLL | 4964 | 60.000 |
| 303 | HCV 2a | 42 | 44 | 10 | B7 | SPGSpSRGGM | 4965 | 30.000 |
| 304 | HCV 2a | 42 | 112 | 10 | B7 | TVRRlLGGGV | 4966 | 10.000 |
| 305 | HCV 2a | 42 | 44 | 10 | B_3501 | SPGSpSRGGM | 4967 | 40.000 |
| 306 | HCV 2a | 42 | 78 | 10 | B_3501 | APVErPESPL | 4968 | 40.000 |
| 307 | HCV 2a | 42 | 91 | 10 | B_3501 | WPKVlMASCW | 4969 | 30.000 |
| 308 | HCV 2a | 42 | 20 | 10 | B_4403 | SEPGaASPPW | 4970 | 54.000 |
| 309 | HCV 2a | 42 | 54 | 10 | B_4403 | EEVEpVSERA | 4971 | 12.000 |
| 310 | HCV 2a | 43 | | | | no hits | | |
| 311 | HCV 2a | 44 | | | | no hits | | |
| 312 | HCV 2a | 45 | | | | no hits | | |
| 313 | HCV 2a | 46 | 1 | 9 | A_0201 | MLAPQGHRV | 4972 | 118.238 |
| 314 | HCV 2a | 46 | 10 | 9 | A_0201 | VMMPVPAHT | 4973 | 33.853 |
| 315 | HCV 2a | 46 | 3 | 9 | B7 | APQGHRVVM | 4974 | 90.000 |
| 316 | HCV 2a | 46 | 12 | 9 | B7 | MPVPAHTPL | 4975 | 80.000 |
| 317 | HCV 2a | 46 | 3 | 9 | B_3501 | APQGHRVVM | 4976 | 40.000 |
| 318 | HCV 2a | 46 | 12 | 9 | B_3501 | MPVPAHTPL | 4977 | 20.000 |
| 319 | HCV 2a | 46 | 11 | 10 | A_0201 | MMPVpAHTPL | 4978 | 26.228 |
| 320 | HCV 2a | 46 | 3 | 10 | B7 | APQGhRVVMM | 4979 | 60.000 |
| 321 | HCV 2a | 46 | 3 | 10 | B_3501 | APQGhRVVMM | 4980 | 40.000 |
| 322 | HCV 2a | 47 | 25 | 9 | A_0201 | QLWSLLSRL | 4981 | 407.808 |
| 323 | HCV 2a | 47 | 28 | 9 | A_0201 | SLLSRLVIV | 4982 | 242.674 |
| 324 | HCV 2a | 47 | 35 | 9 | A_0201 | IVREPSSWV | 4983 | 17.731 |
| 325 | HCV 2a | 47 | 29 | 9 | A3 | LLSRLVIVR | 4984 | 24.000 |
| 326 | HCV 2a | 47 | 22 | 9 | B7 | SVIQLWSLL | 4985 | 20.000 |
| 327 | HCV 2a | 47 | 35 | 9 | B7 | IVREPSSWV | 4986 | 15.000 |
| 328 | HCV 2a | 47 | 10 | 9 | B_3501 | RSHEPAHGM | 4987 | 40.000 |
| 329 | HCV 2a | 47 | 25 | 10 | A_0201 | QLWSlLSRLV | 4988 | 115.456 |
| 330 | HCV 2a | 47 | 34 | 10 | A_0201 | VIVRePSSWV | 4989 | 89.418 |
| 331 | HCV 2a | 47 | 17 | 10 | A_0201 | GMGQsSVIQL | 4990 | 35.485 |
| 332 | HCV 2a | 47 | 24 | 10 | A_0201 | IQLWsLLSRL | 4991 | 31.334 |
| 333 | HCV 2a | 47 | 28 | 10 | A3 | SLLSrLVIVR | 4992 | 36.000 |
| 334 | HCV 2a | 47 | 17 | 10 | A3 | GMGQsSVIQL | 4993 | 10.800 |
| 335 | HCV 2a | 47 | 37 | 10 | B_4403 | REPSsWVTRC | 4994 | 18.000 |
| 336 | HCV 2a | 48 | 109 | 9 | A_0201 | RMLRRIVVL | 4995 | 53.831 |
| 337 | HCV 2a | 48 | 110 | 9 | A_0201 | MLRRIVVLV | 4996 | 20.668 |
| 338 | HCV 2a | 48 | 74 | 9 | A_0201 | TLPRPMLPT | 4997 | 17.140 |
| 339 | HCV 2a | 48 | 19 | 9 | A_0201 | RMPAQMTPT | 4998 | 12.379 |
| 340 | HCV 2a | 48 | 109 | 9 | A24 | RMLRRIVVL | 4999 | 12.000 |
| 341 | HCV 2a | 48 | 114 | 9 | A24 | IVVLVDNGL | 5000 | 10.080 |
| 342 | HCV 2a | 48 | 116 | 9 | A3 | VLVDNGLVR | 5001 | 12.000 |
| 343 | HCV 2a | 48 | 114 | 9 | B7 | IVVLVDNGL | 5002 | 20.000 |
| 344 | HCV 2a | 48 | 75 | 9 | B7 | LPRPMLPTA | 5003 | 20.000 |
| 345 | HCV 2a | 48 | 122 | 9 | B7 | LVRAALNAI | 5004 | 20.000 |
| 346 | HCV 2a | 48 | 103 | 9 | B7 | DASQPPRML | 5005 | 18.000 |
| 347 | HCV 2a | 48 | 67 | 9 | B7 | PARISTSTL | 5006 | 12.000 |
| 348 | HCV 2a | 48 | 37 | 9 | B7 | GSRLMTSSM | 5007 | 10.000 |
| 349 | HCV 2a | 48 | 37 | 9 | B_3501 | GSRLMTSSM | 5008 | 30.000 |
| 350 | HCV 2a | 48 | 58 | 9 | B_3501 | RAPEMPAPY | 5009 | 24.000 |
| 351 | HCV 2a | 48 | 139 | 9 | B_3501 | GSVDSPARY | 5010 | 20.000 |
| 352 | HCV 2a | 48 | 109 | 10 | A_0201 | RMLRrIVVLV | 5011 | 427.474 |
| 353 | HCV 2a | 48 | 116 | 10 | A_0201 | VLVDnGLVRA | 5012 | 79.642 |
| 354 | HCV 2a | 48 | 121 | 10 | A_0201 | GLVRaALNAI | 5013 | 23.995 |
| 355 | HCV 2a | 48 | 74 | 10 | A_0201 | TLPRpMLPTA | 5014 | 11.426 |
| 356 | HCV 2a | 48 | 113 | 10 | A24 | RIVVLVDNGL | 5015 | 20.160 |
| 357 | HCV 2a | 48 | 80 | 10 | B7 | LPTAaPTRPL | 5016 | 120.000 |
| 358 | HCV 2a | 48 | 66 | 10 | B7 | YPARiSTSTL | 5017 | 80.000 |
| 359 | HCV 2a | 48 | 122 | 10 | B7 | LVRAaLNAIM | 5018 | 50.000 |
| 360 | HCV 2a | 48 | 11 | 10 | B7 | SPGPtWRRRM | 5019 | 30.000 |
| 361 | HCV 2a | 48 | 75 | 10 | B7 | LPRPmLPTAA | 5020 | 20.000 |
| 362 | HCV 2a | 48 | 11 | 10 | B_3501 | SPGPtWRRRM | 5021 | 40.000 |
| 363 | HCV 2a | 48 | 66 | 10 | B_3501 | YPARiSTSTL | 5022 | 20.000 |
| 364 | HCV 2a | 48 | 80 | 10 | B_3501 | LPTAaPTRPL | 5023 | 20.000 |
| 365 | HCV 2a | 48 | 43 | 10 | B_3501 | SSMEgFSPDM | 5024 | 20.000 |
| 366 | HCV 2a | 48 | 92 | 10 | B_3501 | KPVApAGGAI | 5025 | 16.000 |
| 367 | HCV 2a | 48 | 70 | 10 | B_3501 | ISTStLPRPM | 5026 | 10.000 |
| 368 | HCV 2a | 48 | 128 | 10 | B_4403 | NAIMeATAGF | 5027 | 11.250 |
| 369 | HCV 2a | 49 | 40 | 9 | A_0201 | WILDFSISA | 5028 | 181.139 |
| 370 | HCV 2a | 49 | 9 | 9 | A_0201 | CLAQNCSTL | 5029 | 21.362 |
| 371 | HCV 2a | 49 | 41 | 9 | A_0201 | ILDFSISAI | 5030 | 16.317 |
| 372 | HCV 2a | 49 | 38 | 9 | A_0201 | KPWILDFSI | 5031 | 11.475 |
| 373 | HCV 2a | 49 | 51 | 9 | B7 | CPSSMRAAL | 5032 | 120.000 |
| 374 | HCV 2a | 49 | 34 | 9 | B7 | ACCNKPWIL | 5033 | 12.000 |
| 375 | HCV 2a | 49 | 24 | 9 | B7 | AGCMSWACL | 5034 | 12.000 |

TABLE 4f-continued

2a (4-6)

| No. | Strain | ORF | Start | AA | HLA | Peptide sequence | SEQ ID NO | Score |
|---|---|---|---|---|---|---|---|---|
| 376 | HCV 2a | 49 | 34 | 9 | B8 | ACCNKPWIL | 5035 | 16.000 |
| 377 | HCV 2a | 49 | 51 | 9 | B_3501 | CPSSMRAAL | 5036 | 20.000 |
| 378 | HCV 2a | 49 | 38 | 9 | B_3501 | KPWILDFSI | 5037 | 16.000 |
| 379 | HCV 2a | 49 | 32 | 9 | B_4403 | LEACCNKPW | 5038 | 36.000 |
| 380 | HCV 2a | 49 | 19 | 9 | B_4403 | HEASTAGCM | 5039 | 12.000 |
| 381 | HCV 2a | 49 | 41 | 10 | A1 | ILDFsISAIR | 5040 | 10.000 |
| 382 | HCV 2a | 49 | 40 | 10 | A_0201 | WILDfSISAI | 5041 | 230.237 |
| 383 | HCV 2a | 49 | 50 | 10 | A24 | RCPSsMRAAL | 5042 | 12.000 |
| 384 | HCV 2a | 49 | 1 | 10 | B7 | MPLMkFHMCL | 5043 | 80.000 |
| 385 | HCV 2a | 49 | 23 | 10 | B7 | TAGCmSWACL | 5044 | 12.000 |
| 386 | HCV 2a | 49 | 33 | 10 | B7 | EACCnKPWIL | 5045 | 12.000 |
| 387 | HCV 2a | 49 | 33 | 10 | B8 | EACCnKPWIL | 5046 | 32.000 |
| 388 | HCV 2a | 49 | 1 | 10 | B_3501 | MPLMkFHMCL | 5047 | 20.000 |
| 389 | HCV 2a | 49 | 46 | 10 | B_3501 | ISAIrCPSSM | 5048 | 10.000 |
| 390 | HCV 2a | 49 | 19 | 10 | B_4403 | HEAStAGCMS | 5049 | 12.000 |
| 391 | HCV 2a | 50 | 57 | 9 | A1 | VTEPKRYRR | 5050 | 450.000 |
| 392 | HCV 2a | 50 | 6 | 9 | A1 | MMETHPVAK | 5051 | 18.000 |
| 393 | HCV 2a | 50 | 8 | 9 | A1 | ETHPVAKQY | 5052 | 12.500 |
| 394 | HCV 2a | 50 | 39 | 9 | A_0201 | CMHVAMYFV | 5053 | 635.435 |
| 395 | HCV 2a | 50 | 43 | 9 | A_0201 | AMYFVTGCV | 5054 | 20.897 |
| 396 | HCV 2a | 50 | 62 | 9 | A24 | RYRRGVGPT | 5055 | 10.000 |
| 397 | HCV 2a | 50 | 6 | 9 | A3 | MMETHPVAK | 5056 | 20.000 |
| 398 | HCV 2a | 50 | 23 | 9 | B7 | TPPARTHVL | 5057 | 80.000 |
| 399 | HCV 2a | 50 | 66 | 9 | B7 | GVGPTRVGL | 5058 | 30.000 |
| 400 | HCV 2a | 50 | 4 | 9 | B7 | RPMMETHPV | 5059 | 12.000 |
| 401 | HCV 2a | 50 | 74 | 9 | B7 | LSRVRHFHM | 5060 | 10.000 |
| 402 | HCV 2a | 50 | 74 | 9 | B8 | LSRVRHFHM | 5061 | 20.000 |
| 403 | HCV 2a | 50 | 23 | 9 | B8 | TPPARTHVL | 5062 | 16.000 |
| 404 | HCV 2a | 50 | 74 | 9 | B_3501 | LSRVRHFHM | 5063 | 30.000 |
| 405 | HCV 2a | 50 | 36 | 9 | B_3501 | RSACMHVAM | 5064 | 20.000 |
| 406 | HCV 2a | 50 | 23 | 9 | B_3501 | TPPARTHVL | 5065 | 20.000 |
| 407 | HCV 2a | 50 | 59 | 9 | B_3501 | EPKRYRRGV | 5066 | 12.000 |
| 408 | HCV 2a | 50 | 4 | 9 | B_3501 | RPMMETHPV | 5067 | 12.000 |
| 409 | HCV 2a | 50 | 83 | 9 | B_3501 | TSQDGGGAL | 5068 | 10.000 |
| 410 | HCV 2a | 50 | 8 | 9 | B_4403 | ETHPVAKQY | 5069 | 20.250 |
| 411 | HCV 2a | 50 | 37 | 9 | B_4403 | SACMHVAMY | 5070 | 18.000 |
| 412 | HCV 2a | 50 | 57 | 10 | A1 | VTEPkRYRRG | 5071 | 22.500 |
| 413 | HCV 2a | 50 | 73 | 10 | A_0201 | GLSRvRHFHM | 5072 | 28.814 |
| 414 | HCV 2a | 50 | 38 | 10 | A_0201 | ACMHvAMYFV | 5073 | 21.250 |
| 415 | HCV 2a | 50 | 39 | 10 | A_0201 | CMHVaMYFVT | 5074 | 19.198 |
| 416 | HCV 2a | 50 | 22 | 10 | A24 | KTPPaRTHVL | 5075 | 14.400 |
| 417 | HCV 2a | 50 | 65 | 10 | A24 | RGVGpTRVGL | 5076 | 12.000 |
| 418 | HCV 2a | 50 | 43 | 10 | A3 | AMYFvTGCVK | 5077 | 100.000 |
| 419 | HCV 2a | 50 | 31 | 10 | B7 | LVMTsRSACM | 5078 | 15.000 |
| 420 | HCV 2a | 50 | 36 | 10 | B_3501 | RSACmHVAMY | 5079 | 20.000 |
| 421 | HCV 2a | 50 | 54 | 10 | B_3501 | TSLVtEPKRY | 5080 | 15.000 |
| 422 | HCV 2a | 50 | 7 | 10 | B_4403 | METHpVAKQY | 5081 | 405.000 |
| 423 | HCV 2a | 50 | 31 | 10 | B_4403 | RSACmHVAMY | 5082 | 18.000 |
| 424 | HCV 2a | 51 | 30 | 9 | A_0201 | SLTVVSAGV | 5083 | 69.552 |
| 425 | HCV 2a | 51 | 28 | 9 | A_0201 | ALSLTVVSA | 5084 | 11.426 |
| 426 | HCV 2a | 51 | 26 | 9 | A24 | KYALSLTVV | 5085 | 10.000 |
| 427 | HCV 2a | 51 | 21 | 9 | B7 | KPGVLKYAL | 5086 | 80.000 |
| 428 | HCV 2a | 51 | 23 | 9 | B7 | GVLKYALSL | 5087 | 20.000 |
| 429 | HCV 2a | 51 | 21 | 9 | B_3501 | KPGVLKYAL | 5088 | 40.000 |
| 430 | HCV 2a | 51 | 19 | 9 | B_4403 | TGKPGVLKY | 5089 | 27.000 |
| 431 | HCV 2a | 51 | 15 | 10 | A_0201 | WSWHtGKPGV | 5090 | 17.334 |
| 432 | HCV 2a | 51 | 26 | 10 | A24 | KYALsLTVVS | 5091 | 12.000 |
| 433 | HCV 2a | 51 | 18 | 10 | B_4403 | HTGKpGVLKY | 5092 | 13.500 |
| 434 | HCV 2a | 52 | | | | no hits | | |
| 435 | HCV 2a | 53 | 14 | 9 | A_0201 | FEWQKIKCL | 5093 | 36.476 |
| 436 | HCV 2a | 53 | 18 | 9 | B_3501 | KIKCLPPLM | 5094 | 12.000 |
| 437 | HCV 2a | 53 | 13 | 10 | A24 | FFEWqKIKCL | 5095 | 30.000 |
| 438 | HCV 2a | 54 | 1 | 9 | B7 | MPRMVVAST | 5096 | 20.000 |
| 439 | HCV 2a | 54 | 1 | 10 | B7 | MPRMvVASTA | 5097 | 20.000 |
| 440 | HCV 2a | 54 | 7 | 10 | B_3501 | ASTAwHSSHM | 5098 | 10.000 |
| 441 | HCV 2a | 55 | 16 | 9 | A1 | GLMPCALDK | 5099 | 10.000 |
| 442 | HCV 2a | 55 | 52 | 9 | A_0201 | TLVLFPLPV | 5100 | 264.298 |
| 443 | HCV 2a | 55 | 41 | 9 | A_0201 | TLYPWAAYA | 5101 | 87.437 |
| 444 | HCV 2a | 55 | 12 | 9 | A_0201 | VLMLGLMPC | 5102 | 71.872 |
| 445 | HCV 2a | 55 | 13 | 9 | A_0201 | LMLGLMPCA | 5103 | 51.908 |
| 446 | HCV 2a | 55 | 14 | 9 | A_0201 | MLGLMPCAL | 5104 | 36.316 |
| 447 | HCV 2a | 55 | 54 | 9 | A_0201 | VLFPLPVGA | 5105 | 31.249 |
| 448 | HCV 2a | 55 | 7 | 9 | A_0201 | TVLTPVLML | 5106 | 15.907 |
| 449 | HCV 2a | 55 | 47 | 9 | A24 | AYATGTLVL | 5107 | 200.000 |
| 450 | HCV 2a | 55 | 24 | 9 | A24 | KYAPNPRVA | 5108 | 12.000 |

TABLE 4f-continued 2a (4-6)

| No. | Strain | ORF | Start | AA | HLA | Peptide sequence | SEQ ID NO | Score |
|---|---|---|---|---|---|---|---|---|
| 451 | HCV 2a | 55 | 16 | 9 | A3 | GLMPCALDK | 5109 | 270.000 |
| 452 | HCV 2a | 55 | 7 | 9 | B7 | TVLTPVLML | 5110 | 30.000 |
| 453 | HCV 2a | 55 | 5 | 9 | B7 | VVTVLTPVL | 5111 | 20.000 |
| 454 | HCV 2a | 55 | 10 | 9 | B7 | TPVLMLGLM | 5112 | 20.000 |
| 455 | HCV 2a | 55 | 45 | 9 | B7 | WAAYATGTL | 5113 | 12.000 |
| 456 | HCV 2a | 55 | 1 | 9 | B7 | MAAPVVTVL | 5114 | 12.000 |
| 457 | HCV 2a | 55 | 10 | 9 | B_3501 | TPVLMLGLM | 5115 | 40.000 |
| 458 | HCV 2a | 55 | 40 | 9 | B_4403 | STLYPWAAY | 5116 | 12.000 |
| 459 | HCV 2a | 55 | 13 | 10 | A_0201 | LMLGLMPCAL | 5117 | 97.045 |
| 460 | HCV 2a | 55 | 8 | 10 | A_0201 | VLTPvLMLGL | 5118 | 83.527 |
| 461 | HCV 2a | 55 | 12 | 10 | A_0201 | VLMLgLMPCA | 5119 | 71.872 |
| 462 | HCV 2a | 55 | 17 | 10 | A_0201 | LMPCaLDKYA | 5120 | 33.548 |
| 463 | HCV 2a | 55 | 41 | 10 | A_0201 | TLYPwAAYAT | 5121 | 23.846 |
| 464 | HCV 2a | 55 | 51 | 10 | A_0201 | GTLVLFPLPV | 5122 | 13.582 |
| 465 | HCV 2a | 55 | 47 | 10 | A24 | AYATgTLVLF | 5123 | 100.000 |
| 466 | HCV 2a | 55 | 24 | 10 | A24 | KYAPnPRVAA | 5124 | 12.000 |
| 467 | HCV 2a | 55 | 16 | 10 | A3 | GLMPcALDKY | 5125 | 40.500 |
| 468 | HCV 2a | 55 | 28 | 10 | B7 | NPRVaATEGL | 5126 | 800.000 |
| 469 | HCV 2a | 55 | 46 | 10 | B7 | AAYAtGTLVL | 5127 | 36.000 |
| 470 | HCV 2a | 55 | 3 | 10 | B7 | APVVtVLTPV | 5128 | 12.000 |
| 471 | HCV 2a | 55 | 49 | 10 | B7 | ATGTlVLFPL | 5129 | 12.000 |
| 472 | HCV 2a | 55 | 28 | 10 | B8 | NPRVaATEGL | 5130 | 16.000 |
| 473 | HCV 2a | 55 | 28 | 10 | B_3501 | NPRVaATEGL | 5131 | 60.000 |
| 474 | HCV 2a | 55 | 56 | 10 | B_3501 | FPLPvGACKY | 5132 | 40.000 |
| 475 | HCV 2a | 55 | 39 | 10 | B_3501 | TSTLyPWAAY | 5133 | 10.000 |
| 476 | HCV 2a | 55 | 34 | 10 | B_4403 | TEGLsTSTLY | 5134 | 180.000 |
| 477 | HCV 2a | 55 | 56 | 10 | B_4403 | FPLPvGACKY | 5135 | 27.000 |
| 478 | HCV 2a | 56 | 36 | 9 | A_0201 | GPPEDPFKV | 5136 | 10.797 |
| 479 | HCV 2a | 56 | 47 | 9 | A3 | GLGESNAPR | 5137 | 18.000 |
| 480 | HCV 2a | 56 | 108 | 9 | B7 | GPREPARVL | 5138 | 1.200.000 |
| 481 | HCV 2a | 56 | 93 | 9 | B7 | HPTKSPSAL | 5139 | 80.000 |
| 482 | HCV 2a | 56 | 40 | 9 | B7 | DPFKVERGL | 5140 | 80.000 |
| 483 | HCV 2a | 56 | 57 | 9 | B7 | SPRLRAGMT | 5141 | 20.000 |
| 484 | HCV 2a | 56 | 52 | 9 | B7 | NAPRLSPRL | 5142 | 12.000 |
| 485 | HCV 2a | 56 | 108 | 9 | B8 | GPREPARVL | 5143 | 24.000 |
| 486 | HCV 2a | 56 | 57 | 9 | B8 | SPRLRAGMT | 5144 | 16.000 |
| 487 | HCV 2a | 56 | 108 | 9 | B_3501 | GPREPARVL | 5145 | 120.000 |
| 488 | HCV 2a | 56 | 40 | 9 | B_3501 | DPFKVERGL | 5146 | 20.000 |
| 489 | HCV 2a | 56 | 93 | 9 | B_3501 | HPTKSPSAL | 5147 | 20.000 |
| 490 | HCV 2a | 56 | 36 | 9 | B_3501 | GPPEDPFKV | 5148 | 12.000 |
| 491 | HCV 2a | 56 | 65 | 9 | B_3501 | TSAFRVTRY | 5149 | 10.000 |
| 492 | HCV 2a | 56 | 56 | 9 | B_3501 | LSPRLRAGM | 5150 | 10.000 |
| 493 | HCV 2a | 56 | 65 | 9 | B_4403 | TSAFRVTRY | 5151 | 27.000 |
| 494 | HCV 2a | 56 | 17 | 9 | B_4403 | REHTAARKI | 5152 | 13.500 |
| 495 | HCV 2a | 56 | 34 | 10 | A1 | STGPpEDPFK | 5153 | 10.000 |
| 496 | HCV 2a | 56 | 47 | 10 | A_0201 | GLGEsNAPRL | 5154 | 87.586 |
| 497 | HCV 2a | 56 | 63 | 10 | A3 | GMTSaFRVTR | 5155 | 36.000 |
| 498 | HCV 2a | 56 | 108 | 10 | B7 | GREpARVLL | 5156 | 1.200.000 |
| 499 | HCV 2a | 56 | 77 | 10 | B7 | APHEhGSKDL | 5157 | 240.000 |
| 500 | HCV 2a | 56 | 53 | 10 | B7 | APRLsPRLRA | 5158 | 135.000 |
| 501 | HCV 2a | 56 | 4 | 10 | B7 | ASTGmKSMDL | 5159 | 12.000 |
| 502 | HCV 2a | 56 | 108 | 10 | B8 | GPREpARVLL | 5160 | 24.000 |
| 503 | HCV 2a | 56 | 108 | 10 | B_3501 | GPREpARVLL | 5161 | 120.000 |
| 504 | HCV 2a | 56 | 77 | 10 | B_3501 | APHEhGSKDL | 5162 | 40.000 |
| 505 | HCV 2a | 56 | 82 | 10 | B_3501 | GSKDlVPGGL | 5163 | 30.000 |
| 506 | HCV 2a | 56 | 2 | 10 | B_3501 | SSAStGMKSM | 5164 | 10.000 |
| 507 | HCV 2a | 56 | 64 | 10 | B_4403 | MTSAfRVTRY | 5165 | 13.500 |
| 508 | HCV 2a | 57 | 31 | 9 | A_0201 | TMAPKRPRV | 5166 | 50.232 |
| 509 | HCV 2a | 57 | 22 | 9 | A_0201 | VLSRPVMLT | 5167 | 29.137 |
| 510 | HCV 2a | 57 | 8 | 9 | A_0201 | WVTVDRTWI | 5168 | 23.096 |
| 511 | HCV 2a | 57 | 27 | 9 | A3 | VMLTTMAPK | 5169 | 45.000 |
| 512 | HCV 2a | 57 | 3 | 9 | B7 | VPRKDWVTV | 5170 | 40.000 |
| 513 | HCV 2a | 57 | 21 | 9 | B7 | SVLSRPVML | 5171 | 20.000 |
| 514 | HCV 2a | 57 | 33 | 9 | B_3501 | APKRPRVCW | 5172 | 30.000 |
| 515 | HCV 2a | 57 | 3 | 9 | B_3501 | VPRKDWVTV | 5173 | 18.000 |
| 516 | HCV 2a | 57 | 20 | 9 | B_3501 | CSVLSRPVM | 5174 | 10.000 |
| 517 | HCV 2a | 57 | 22 | 10 | A_0201 | VLSRpVMLTT | 5175 | 29.137 |
| 518 | HCV 2a | 57 | 23 | 10 | B7 | LSRPvMLTTM | 5176 | 10.000 |
| 519 | HCV 2a | 57 | 33 | 10 | B8 | APKRpRVCWA | 5177 | 16.000 |
| 520 | HCV 2a | 57 | 23 | 10 | B_3501 | LSRPvMLTTM | 5178 | 30.000 |
| 521 | HCV 2a | 58 | | | | no hits | | |
| 522 | HCV 2a | 59 | 12 | 9 | A_0201 | TMTFFSIGL | 5179 | 58.628 |
| 523 | HCV 2a | 59 | 21 | 9 | A_0201 | KMIGSTATA | 5180 | 12.558 |
| 524 | HCV 2a | 59 | 27 | 9 | B7 | ATAKSRRPL | 5181 | 18.000 |
| 525 | HCV 2a | 59 | 28 | 9 | B8 | TAKSRRPLA | 5182 | 16.000 |

TABLE 4f-continued

2a (4-6)

| No. Strain | ORF | Start | AA | HLA | Peptide sequence | SEQ ID NO | Score |
|---|---|---|---|---|---|---|---|
| 526 HCV 2a | 59 | 33 | 9 | B_3501 | RPLAAQSDI | 5183 | 16.000 |
| 527 HCV 2a | 59 | 21 | 10 | A3 | KMIGsTATAK | 5184 | 135.000 |
| 528 HCV 2a | 59 | 9 | 10 | B7 | APQTmTFFSI | 5185 | 24.000 |
| 529 HCV 2a | 59 | 26 | 10 | B7 | TATAkSRRPL | 5186 | 18.000 |
| 530 HCV 2a | 59 | 11 | 10 | B7 | QTMTfFSIGL | 5187 | 12.000 |
| 531 HCV 2a | 59 | 28 | 10 | B8 | TAKSrRPLAA | 5188 | 16.000 |
| 532 HCV 2a | 60 | 16 | 10 | B7 | MPSRpPRACM | 5189 | 45.000 |
| 533 HCV 2a | 60 | 16 | 10 | B_3501 | MPSRpPRACM | 5190 | 40.000 |
| 534 HCV 2a | 60 | 1 | 10 | B_3501 | MSNTtPGQNM | 5191 | 10.000 |
| 535 HCV 2a | 61 |  |  |  | no hits |  |  |
| 536 HCV 2a | 62 | 8 | 9 | A_0201 | KMTKYRKPL | 5192 | 53.999 |
| 537 HCV 2a | 62 | 133 | 9 | A_0201 | KLHAAVSLC | 5193 | 39.992 |
| 538 HCV 2a | 62 | 104 | 9 | A_0201 | KMAHSVVEC | 5194 | 28.883 |
| 539 HCV 2a | 62 | 1 | 9 | A24 | MYQAATKKM | 5195 | 41.250 |
| 540 HCV 2a | 62 | 11 | 9 | A24 | KYRKPLQLA | 5196 | 12.000 |
| 541 HCV 2a | 62 | 17 | 9 | A3 | QLAALAACK | 5197 | 20.000 |
| 542 HCV 2a | 62 | 82 | 9 | A3 | TIFWWRWSR | 5198 | 18.000 |
| 543 HCV 2a | 62 | 76 | 9 | A3 | YMYCTSTIF | 5199 | 10.000 |
| 544 HCV 2a | 62 | 126 | 9 | B7 | SQRSPRVKL | 5200 | 90.000 |
| 545 HCV 2a | 62 | 143 | 9 | B7 | IPPTYILIL | 5201 | 80.000 |
| 546 HCV 2a | 62 | 112 | 9 | B7 | CNRGDSWLL | 5202 | 40.000 |
| 547 HCV 2a | 62 | 129 | 9 | B7 | SPRVKLHAA | 5203 | 20.000 |
| 548 HCV 2a | 62 | 129 | 9 | B8 | SPRVKLHAA | 5204 | 16.000 |
| 549 HCV 2a | 62 | 51 | 9 | B8 | SARRRNKST | 5205 | 16.000 |
| 550 HCV 2a | 62 | 70 | 9 | B_3501 | RAGDRPYMY | 5206 | 24.000 |
| 551 HCV 2a | 62 | 143 | 9 | B_3501 | IPPTYILIL | 5207 | 20.000 |
| 552 HCV 2a | 62 | 4 | 9 | B_4403 | AATKKMTKY | 5208 | 20.250 |
| 553 HCV 2a | 62 | 98 | 9 | B_4403 | SEKEQGKMA | 5209 | 12.000 |
| 554 HCV 2a | 62 | 110 | 9 | B_4403 | VECNRGDSW | 5210 | 12.000 |
| 555 HCV 2a | 62 | 139 | 10 | A_0201 | SLCSiPPTYI | 5211 | 57.380 |
| 556 HCV 2a | 62 | 75 | 10 | A24 | PYMYcTSTIF | 5212 | 15.000 |
| 557 HCV 2a | 62 | 125 | 10 | A24 | KSQRsPRVKL | 5213 | 13.200 |
| 558 HCV 2a | 62 | 11 | 10 | A24 | KYRKpLQLAA | 5214 | 12.000 |
| 559 HCV 2a | 62 | 68 | 10 | B7 | FVRAgDRPYM | 5215 | 75.000 |
| 560 HCV 2a | 62 | 129 | 10 | B7 | SPRVkLHAAV | 5216 | 40.000 |
| 561 HCV 2a | 62 | 131 | 10 | B7 | RVKLhAAVSL | 5217 | 20.000 |
| 562 HCV 2a | 62 | 9 | 10 | B8 | MTKYrKPLQL | 5218 | 80.000 |
| 563 HCV 2a | 62 | 123 | 10 | B8 | SSKSqRSPRV | 5219 | 12.000 |
| 564 HCV 2a | 62 | 74 | 10 | B_3501 | RPYMyCTSTI | 5220 | 16.000 |
| 565 HCV 2a | 62 | 129 | 10 | B_3501 | SPRVkLHAAV | 5221 | 12.000 |
| 566 HCV 2a | 62 | 138 | 10 | B_3501 | VSLCsIPPTY | 5222 | 10.000 |
| 567 HCV 2a | 62 | 125 | 10 | B_3501 | KSQRsPRVKL | 5223 | 10.000 |
| 568 HCV 2a | 62 | 3 | 10 | B_4403 | QAATkKMTKY | 5224 | 20.250 |
| 569 HCV 2a | 63 | 30 | 9 | A_0201 | VLFNRKTSV | 5225 | 437.482 |
| 570 HCV 2a | 63 | 9 | 9 | A_0201 | VLVKPVEFI | 5226 | 109.935 |
| 571 HCV 2a | 63 | 6 | 9 | B7 | APQVLVKPV | 5227 | 12.000 |
| 572 HCV 2a | 63 | 24 | 9 | B_3501 | DPRGGRVLF | 5228 | 60.000 |
| 573 HCV 2a | 63 | 29 | 10 | A_0201 | RVLFnRKTSV | 5229 | 22.517 |
| 574 HCV 2a | 63 | 8 | 10 | A_0201 | QVLVkPVEFI | 5230 | 20.936 |
| 575 HCV 2a | 63 | 35 | 10 | A_0201 | KTSVsFSPHV | 5231 | 12.848 |
| 576 HCV 2a | 63 | 31 | 10 | A24 | LFNRkTSVSF | 5232 | 15.000 |
| 577 HCV 2a | 63 | 24 | 10 | B8 | DPRGgRVLFN | 5233 | 16.000 |
| 578 HCV 2a | 64 | 7 | 9 | A_0201 | VLISWMFCL | 5234 | 484.457 |
| 579 HCV 2a | 64 | 6 | 9 | A_0201 | LVLISWMFC | 5235 | 25.565 |
| 580 HCV 2a | 64 | 7 | 9 | A3 | VLISWMFCL | 5236 | 12.150 |
| 581 HCV 2a | 64 | 4 | 9 | B7 | LPLVLISWM | 5237 | 20.000 |
| 582 HCV 2a | 64 | 4 | 9 | B_3501 | LPLVLISWM | 5238 | 40.000 |
| 583 HCV 2a | 64 | 6 | 10 | A_0201 | LVLIsWMFCL | 5239 | 156.843 |
| 584 HCV 2a | 64 | 3 | 10 | A_0201 | QLPLvLISWM | 5240 | 62.845 |
| 585 HCV 2a | 64 | 16 | 10 | B7 | EPGErRPAKL | 5241 | 80.000 |
| 586 HCV 2a | 64 | 6 | 10 | B7 | LVLIsWMFCL | 5242 | 20.000 |
| 587 HCV 2a | 64 | 16 | 10 | B8 | EPGErRPAKL | 5243 | 48.000 |
| 588 HCV 2a | 64 | 19 | 10 | B8 | ERRPaKLSVL | 5244 | 16.000 |
| 589 HCV 2a | 64 | 16 | 10 | B_3501 | EPGErRPAKL | 5245 | 40.000 |
| 590 HCV 2a | 64 | 4 | 10 | B_3501 | LPLVLISWMF | 5246 | 20.000 |
| 591 HCV 2a | 65 | 4 | 10 | A3 | TLAHaPCIEK | 5247 | 60.000 |
| 592 HCV 2a | 66 | 3 | 9 | A_0201 | SMMTSGTRI | 5248 | 27.879 |
| 593 HCV 2a | 67 | 19 | 9 | A_0201 | VMVPRMEQL | 5249 | 29.559 |
| 594 HCV 2a | 67 | 39 | 9 | A_0201 | IMNIWAASI | 5250 | 12.809 |
| 595 HCV 2a | 67 | 37 | 9 | B_4403 | GEIMNIWAA | 5251 | 20.000 |
| 596 HCV 2a | 67 | 10 | 10 | A_0201 | IMSHaIRCPV | 5252 | 85.394 |
| 597 HCV 2a | 67 | 26 | 10 | A_0201 | QLHScTNQWC | 5253 | 27.324 |
| 598 HCV 2a | 67 | 21 | 10 | B7 | VPRMeQLHSC | 5254 | 20.000 |
| 599 HCV 2a | 67 | 11 | 10 | B_3501 | MSHAiRCPVM | 5255 | 10.000 |
| 600 HCV 2a | 67 | 37 | 10 | B_4403 | GEIMnIWAAS | 5256 | 20.000 |

TABLE 4f-continued

2a (4-6)

| No. | Strain | ORF | Start | AA | HLA | Peptide sequence | SEQ ID NO | Score |
|---|---|---|---|---|---|---|---|---|
| 601 | HCV 2a | 68 | 2 | 9 | A_0201 | SMCVRKPCV | 5257 | 50.232 |
| 602 | HCV 2a | 68 | 25 | 9 | A_0201 | IQHRDVFPT | 5258 | 17.134 |
| 603 | HCV 2a | 68 | 12 | 9 | B7 | APRCCTATF | 5259 | 12.000 |
| 604 | HCV 2a | 68 | 9 | 9 | B7 | CVRAPRCCT | 5260 | 11.250 |
| 605 | HCV 2a | 68 | 12 | 9 | B_3501 | APRCCTATF | 5261 | 60.000 |
| 606 | HCV 2a | 68 | 24 | 10 | A_0201 | GIQHrDVFPT | 5262 | 13.669 |
| 607 | HCV 2a | 69 | 1 | 9 | A_0201 | MLSLEQSLV | 5263 | 118.238 |
| 608 | HCV 2a | 69 | 2 | 10 | B_3501 | LSLEqSLVTM | 5264 | 20.000 |
| 609 | HCV 2a | 70 | 14 | 9 | A_0201 | KEQPGRFPV | 5265 | 27.454 |
| 610 | HCV 2a | 70 | 12 | 9 | B_4403 | IEKEQPGRF | 5266 | 40.000 |
| 611 | HCV 2a | 70 | 14 | 9 | B_4403 | KEQPGRFPV | 5267 | 12.000 |
| 612 | HCV 2a | 71 | 83 | 9 | A1 | RSEVFLVVR | 5268 | 27.000 |
| 613 | HCV 2a | 71 | 121 | 9 | A_0201 | RLVFLLVFL | 5269 | 270.234 |
| 614 | HCV 2a | 71 | 87 | 9 | A_0201 | FLVVRTPNL | 5270 | 98.267 |
| 615 | HCV 2a | 71 | 56 | 9 | A24 | GYPGFPQDL | 5271 | 360.000 |
| 616 | HCV 2a | 71 | 121 | 9 | A24 | RLVFLLVFL | 5272 | 14.400 |
| 617 | HCV 2a | 71 | 69 | 9 | A24 | RSLGMGWRL | 5273 | 12.000 |
| 618 | HCV 2a | 71 | 118 | 9 | B7 | CGRRLVFLL | 5274 | 40.000 |
| 619 | HCV 2a | 71 | 12 | 9 | B7 | RVSMTLPTL | 5275 | 20.000 |
| 620 | HCV 2a | 71 | 117 | 9 | B8 | SCGRRLVFL | 5276 | 16.000 |
| 621 | HCV 2a | 71 | 42 | 9 | B_3501 | HPAQPSPSF | 5277 | 20.000 |
| 622 | HCV 2a | 71 | 69 | 9 | B_3501 | RSLGMGWRL | 5278 | 10.000 |
| 623 | HCV 2a | 71 | 84 | 9 | B_4403 | SEVFLVVRT | 5279 | 48.000 |
| 624 | HCV 2a | 71 | 79 | 10 | A_0201 | RGWDrSEVFL | 5280 | 26.100 |
| 625 | HCV 2a | 71 | 114 | 10 | A_0201 | NLTScGRRLV | 5281 | 13.910 |
| 626 | HCV 2a | 71 | 86 | 10 | A24 | VFLVvRTPNL | 5282 | 30.000 |
| 627 | HCV 2a | 71 | 8 | 10 | A24 | KPHVrVSMTL | 5283 | 11.200 |
| 628 | HCV 2a | 71 | 51 | 10 | A24 | PYRGqGYPGF | 5284 | 10.000 |
| 629 | HCV 2a | 71 | 70 | 10 | A3 | SLGMgWRLPR | 5285 | 24.000 |
| 630 | HCV 2a | 71 | 89 | 10 | B7 | VVRTpNLGPL | 5286 | 200.000 |
| 631 | HCV 2a | 71 | 8 | 10 | B7 | KPHVrVSMTL | 5287 | 80.000 |
| 632 | HCV 2a | 71 | 77 | 10 | B7 | LPRGwDRSEV | 5288 | 60.000 |
| 633 | HCV 2a | 71 | 19 | 10 | B7 | TLRDlCRGSL | 5289 | 60.000 |
| 634 | HCV 2a | 71 | 64 | 10 | B7 | LPVErRSLGM | 5290 | 20.000 |
| 635 | HCV 2a | 71 | 35 | 10 | B7 | EPRGdRSHPA | 5291 | 20.000 |
| 636 | HCV 2a | 71 | 2 | 10 | B7 | YPMRsAKPHV | 5292 | 12.000 |
| 637 | HCV 2a | 71 | 35 | 10 | B8 | EPRGdRSHPA | 5293 | 32.000 |
| 638 | HCV 2a | 71 | 19 | 10 | B8 | TLRDlCRGSL | 5294 | 12.000 |
| 639 | HCV 2a | 71 | 64 | 10 | B_3501 | LPVErRSLGM | 5295 | 80.000 |
| 640 | HCV 2a | 71 | 8 | 10 | B_3501 | KPHVrVSMTL | 5296 | 40.000 |
| 641 | HCV 2a | 71 | 6 | 10 | B_3501 | SAKPhVRVSM | 5297 | 18.000 |
| 642 | HCV 2a | 71 | 77 | 10 | B_3501 | LPRGwDRSEV | 5298 | 18.000 |
| 643 | HCV 2a | 71 | 66 | 10 | B_4403 | VERRsLGMGW | 5299 | 12.000 |

TABLE 4g

2b (1-3)

| No. | Strain | ORF | Start | AA | HLA | Peptide sequence | SEQ ID NO: | Score |
|---|---|---|---|---|---|---|---|---|
| 1 | HCV 2b | 1 | 15 | 9 | A_0201 | LLSSRRKRL | 5257 | 36.32 |
| 2 | HCV 2b | 1 | 17 | 9 | B7 | SSRRKRLAM | 5258 | 15 |
| 3 | HCV 2b | 1 | 2 | 9 | B7 | GATLRHESL | 5259 | 12 |
| 4 | HCV 2b | 1 | 17 | 9 | B8 | SSRRKRLAM | 5260 | 20 |
| 5 | HCV 2b | 1 | 2 | 9 | B8 | GATLRHESL | 5261 | 16 |
| 6 | HCV 2b | 1 | 14 | 10 | B8 | ELLSSRRKRL | 5262 | 16 |
| 7 | HCV 2b | 1 | 17 | 9 | B_3501 | SSRRKRLAM | 5263 | 30 |
| 8 | HCV 2b | 1 | 16 | 10 | B_3501 | LSSRRKRLAM | 5264 | 10 |
| 9 | HCV 2b | 2 | 43 | 9 | A_0201 | VVLPISWGT | 5265 | 30.76 |
| 10 | HCV 2b | 2 | 44 | 10 | A_0201 | VLPISWGTSL | 5266 | 36.32 |
| 11 | HCV 2b | 2 | 20 | 10 | A_0201 | LLGAPATPGI | 5267 | 17.74 |
| 12 | HCV 2b | 2 | 52 | 10 | A_0201 | SLSLaPLSEA | 5268 | 11.43 |
| 13 | HCV 2b | 2 | 45 | 9 | B7 | LPISWGTSL | 5269 | 80 |
| 14 | HCV 2b | 2 | 13 | 9 | B7 | CPLAGLVLL | 5270 | 80 |
| 15 | HCV 2b | 2 | 62 | 9 | B7 | SPELWHTVL | 5271 | 24 |
| 16 | HCV 2b | 2 | 56 | 10 | B7 | APLSEASPEL | 5272 | 240 |
| 17 | HCV 2b | 2 | 6 | 10 | B7 | AVGQVGSCPL | 5273 | 60 |
| 18 | HCV 2b | 2 | 9 | 10 | B7 | QVGSCPLAGL | 5274 | 30 |
| 19 | HCV 2b | 2 | 61 | 10 | B7 | ASPElWHTVL | 5275 | 12 |
| 20 | HCV 2b | 2 | 45 | 9 | B_3501 | LPISWGTSL | 5276 | 20 |
| 21 | HCV 2b | 2 | 13 | 9 | B_3501 | CPLAGLVLL | 5277 | 20 |
| 22 | HCV 2b | 2 | 56 | 10 | B_3501 | APLSEASPEL | 5278 | 20 |

TABLE 4g-continued

2b (1-3)

| No. | Strain | ORF | Start | AA | HLA | Peptide sequence | SEQ ID NO: | Score |
|---|---|---|---|---|---|---|---|---|
| 23 | HCV 2b | 2 | 61 | 10 | B_3501 | ASPELWHTVL | 5279 | 10 |
| 24 | HCV 2b | 2 | 59 | 10 | B_4403 | SEASPELWHT | 5280 | 24 |
| 25 | HCV 2b | 2 | 1 | 10 | B_4403 | METRVAVGQV | 5281 | 18 |
| 26 | HCV 2b | 3 | 37 | 9 | A1 | ATTPLMIAR | 5282 | 12.5 |
| 27 | HCV 2b | 3 | 53 | 9 | A_0201 | SLTQFSIFL | 5283 | 446.47 |
| 28 | HCV 2b | 3 | 11 | 9 | A_0201 | FLSSYLLFC | 5284 | 289.09 |
| 29 | HCV 2b | 3 | 9 | 9 | A_0201 | ALFLSSYLL | 5285 | 79.04 |
| 30 | HCV 2b | 3 | 4 | 9 | A_0201 | GIYPVALFL | 5286 | 51.7 |
| 31 | HCV 2b | 3 | 55 | 9 | A_0201 | TQFSIFLDV | 5287 | 49.57 |
| 32 | HCV 2b | 3 | 16 | 9 | A_0201 | LLFCRALQC | 5288 | 31.25 |
| 33 | HCV 2b | 3 | 35 | 9 | A_0201 | ALATTPLMI | 5289 | 10.43 |
| 34 | HCV 2b | 3 | 8 | 9 | A_0201 | VALFLSSYL | 5290 | 10.26 |
| 35 | HCV 2b | 3 | 15 | 10 | A_0201 | YLLFCRALQC | 5291 | 84.56 |
| 36 | HCV 2b | 3 | 27 | 10 | A_0201 | LQWKSGTSAL | 5292 | 30.56 |
| 37 | HCV 2b | 3 | 52 | 10 | A_0201 | SSLTQFSIFL | 5293 | 10.78 |
| 38 | HCV 2b | 3 | 14 | 9 | A24 | SYLLFCRAL | 5294 | 300 |
| 39 | HCV 2b | 3 | 10 | 9 | A24 | LFLSSYLLF | 5295 | 15 |
| 40 | HCV 2b | 3 | 3 | 10 | A24 | RGIYPVALFL | 5296 | 16.8 |
| 41 | HCV 2b | 3 | 5 | 10 | A24 | IYPVALFLSS | 5297 | 10.8 |
| 42 | HCV 2b | 3 | 21 | 10 | A3 | ALQCQCLQWK | 5298 | 30 |
| 43 | HCV 2b | 3 | 9 | 10 | A3 | ALFLSSYLLF | 5299 | 20 |
| 44 | HCV 2b | 3 | 11 | 10 | A3 | FLSSYLLFCR | 5300 | 18 |
| 45 | HCV 2b | 3 | 69 | 10 | A3 | TMVPCAAGYK | 5301 | 13.5 |
| 46 | HCV 2b | 3 | 9 | 9 | B7 | ALFLSSYLL | 5302 | 12 |
| 47 | HCV 2b | 3 | 8 | 9 | B7 | VALFLSSYL | 5303 | 12 |
| 48 | HCV 2b | 3 | 1 | 10 | B7 | MQRGiYPVAL | 5304 | 40 |
| 49 | HCV 2b | 3 | 18 | 10 | B7 | FCRAlQCQCL | 5305 | 40 |
| 50 | HCV 2b | 3 | 8 | 10 | B7 | VALFlSSYLL | 5306 | 12 |
| 51 | HCV 2b | 3 | 18 | 10 | B8 | FCRAlQCQCL | 5307 | 16 |
| 52 | HCV 2b | 3 | 49 | 9 | B_3501 | SPGSSLTQF | 5308 | 20 |
| 53 | HCV 2b | 3 | 6 | 10 | B_3501 | YPVALFLSSY | 5309 | 40 |
| 54 | HCV 2b | 3 | 33 | 10 | B_3501 | TSALATTPLM | 5310 | 10 |
| 55 | HCV 2b | 3 | 3 | 9 | B_4403 | RGIYPVALF | 5311 | 15 |
| 56 | HCV 2b | 4 | 17 | 9 | A_0201 | ALLASLSLV | 5312 | 591.89 |
| 57 | HCV 2b | 4 | 7 | 9 | B7 | PARQWAGPL | 5313 | 12 |
| 58 | HCV 2b | 4 | 16 | 9 | B7 | GALLASLSL | 5314 | 12 |
| 59 | HCV 2b | 4 | 11 | 9 | B7 | WAGPLGALL | 5315 | 12 |
| 60 | HCV 2b | 4 | 13 | 10 | B7 | GPLGALLASL | 5316 | 80 |
| 61 | HCV 2b | 4 | 2 | 10 | B_3501 | RPPIPPARQW | 5317 | 20 |
| 62 | HCV 2b | 4 | 13 | 10 | B_3501 | GPLGALLASL | 5318 | 20 |
| 63 | HCV 2b | 5 | 27 | 9 | A_0201 | CLPAVGWMI | 5319 | 78.25 |
| 64 | HCV 2b | 5 | 13 | 9 | A_0201 | FMPTNSTAL | 5320 | 70.97 |
| 65 | HCV 2b | 5 | 20 | 9 | A_0201 | ALAAPSVCL | 5321 | 21.36 |
| 66 | HCV 2b | 5 | 36 | 10 | A_0201 | FVSGGEPWNT | 5322 | 22.5 |
| 67 | HCV 2b | 5 | 13 | 10 | A_0201 | FMPTNSTALA | 5323 | 16.51 |
| 68 | HCV 2b | 5 | 12 | 10 | A24 | CFMPTNSTAL | 5324 | 36 |
| 69 | HCV 2b | 5 | 44 | 9 | B7 | NTRPTSPML | 5325 | 40 |
| 70 | HCV 2b | 5 | 20 | 9 | B7 | ALAAPSVCL | 5326 | 18 |
| 71 | HCV 2b | 5 | 23 | 9 | B7 | APSVCLPAV | 5327 | 12 |
| 72 | HCV 2b | 5 | 19 | 10 | B7 | TALAAPSVCL | 5328 | 18 |
| 73 | HCV 2b | 5 | 28 | 9 | B_3501 | LPAVGWMIF | 5329 | 20 |
| 74 | HCV 2b | 6 | | | | no hits | | |
| 75 | HCV 2b | 7 | | | | no hits | | |
| 76 | HCV 2b | 8 | 1 | 10 | B7 | MGRCGSSSFL | 5330 | 40 |
| 77 | HCV 2b | 9 | 43 | 10 | A1 | HVETSCMASR | 5331 | 18 |
| 78 | HCV 2b | 9 | 2 | 10 | A1 | TTSPPCQLGR | 5332 | 12.5 |
| 79 | HCV 2b | 9 | 16 | 9 | A1 | GTWRLPWSL | 5333 | 18.47 |
| 80 | HCV 2b | 9 | 8 | 10 | A1 | QLGRPRVCGT | 5334 | 17.14 |
| 81 | HCV 2b | 9 | 23 | 10 | A1 | SLSCSAQWRR | 5335 | 12 |
| 82 | HCV 2b | 9 | 11 | 10 | B7 | RPRVCGTWRL | 5336 | 800 |
| 83 | HCV 2b | 9 | 11 | 10 | B_3501 | RPRVCGTWRL | 5337 | 120 |
| 84 | HCV 2b | 9 | 44 | 10 | B_4403 | VETSCMASRF | 5338 | 60 |
| 85 | HCV 2b | 10 | | | | no hits | | |
| 86 | HCV 2b | 11 | 32 | 9 | A_0201 | GLVTRPWLA | 5339 | 37.26 |
| 87 | HCV 2b | 11 | 24 | 10 | A24 | GFSGrYITGL | 5340 | 20 |
| 88 | HCV 2b | 11 | 20 | 9 | A3 | HLFRGFSGR | 5341 | 60 |
| 89 | HCV 2b | 11 | 20 | 10 | A3 | HLFRGFSGRY | 5342 | 18 |
| 90 | HCV 2b | 11 | 51 | 10 | B7 | AQRGTSWDGL | 5343 | 120 |
| 91 | HCV 2b | 11 | 1 | 9 | B_3501 | MSRPGRSRF | 5344 | 15 |
| 92 | HCV 2b | 11 | 49 | 9 | B_3501 | TPAQRGTSW | 5345 | 10 |
| 93 | HCV 2b | 11 | 10 | 9 | B_3501 | CPPSHNPSW | 5346 | 10 |
| 94 | HCV 2b | 12 | 26 | 9 | A_0201 | ALGDTPWAC | 5347 | 152.77 |
| 95 | HCV 2b | 12 | 65 | 9 | A_0201 | FLTTARHQL | 5348 | 98.27 |
| 96 | HCV 2b | 12 | 58 | 9 | A_0201 | SLDGRPVFL | 5349 | 47 |
| 97 | HCV 2b | 12 | 47 | 9 | A_0201 | LLTSSRLNL | 5350 | 36.32 |

TABLE 4g-continued

2b (1-3)

| No. | Strain | ORF | Start | AA | HLA | Peptide sequence | SEQ ID NO: | Score |
|---|---|---|---|---|---|---|---|---|
| 98 | HCV 2b | 12 | 76 | 9 | A_0201 | KLTRWATCT | 5351 | 26.08 |
| 99 | HCV 2b | 12 | 46 | 10 | A_0201 | NLLTSSRLNL | 5352 | 79.04 |
| 100 | HCV 2b | 12 | 58 | 10 | A_0201 | SLDGRPVELT | 5353 | 39.76 |
| 101 | HCV 2b | 12 | 65 | 10 | A_0201 | FLTTARHQLC | 5354 | 22.85 |
| 102 | HCV 2b | 12 | 57 | 10 | A_0201 | TSLDGRPVFL | 5355 | 11.64 |
| 103 | HCV 2b | 12 | 64 | 10 | A24 | VFLTTARHQL | 5356 | 30 |
| 104 | HCV 2b | 12 | 40 | 9 | B7 | APGVWPNLL | 5357 | 240 |
| 105 | HCV 2b | 12 | 19 | 9 | B7 | HPEDPCSAL | 5358 | 36 |
| 106 | HCV 2b | 12 | 4 | 9 | B7 | GVHCCRQGL | 5359 | 30 |
| 107 | HCV 2b | 12 | 96 | 9 | B7 | LPHIPVRGI | 5360 | 12 |
| 108 | HCV 2b | 12 | 39 | 9 | B7 | CAPGVWPNL | 5361 | 12 |
| 109 | HCV 2b | 12 | 88 | 9 | B7 | VAGRAPRSL | 5362 | 12 |
| 110 | HCV 2b | 12 | 92 | 10 | B7 | APRSLPHIPV | 5363 | 180 |
| 111 | HCV 2b | 12 | 68 | 10 | B7 | TARHQLCPKL | 5364 | 120 |
| 112 | HCV 2b | 12 | 44 | 10 | B7 | WPNLLTSSRL | 5365 | 80 |
| 113 | HCV 2b | 12 | 50 | 10 | B7 | SSRLNLSTSL | 5366 | 40 |
| 114 | HCV 2b | 12 | 87 | 10 | B7 | QVAGRAPRSL | 5367 | 20 |
| 115 | HCV 2b | 12 | 39 | 10 | B7 | CAPGVWPNLL | 5368 | 12 |
| 116 | HCV 2b | 12 | 68 | 10 | B7 | TARHQLCPKL | 5369 | 16 |
| 117 | HCV 2b | 12 | 74 | 10 | B7 | CPKLTRWATC | 5370 | 16 |
| 118 | HCV 2b | 12 | 40 | 9 | B_3501 | APGVWPNLL | 5371 | 20 |
| 119 | HCV 2b | 12 | 19 | 9 | B_3501 | HPEDPCSAL | 5372 | 12 |
| 120 | HCV 2b | 12 | 57 | 9 | B_3501 | TSLDGRPVF | 5373 | 10 |
| 121 | HCV 2b | 12 | 44 | 10 | B_3501 | WPNLLTSSRL | 5374 | 20 |
| 122 | HCV 2b | 12 | 50 | 10 | B_3501 | SSRLNLSTSL | 5375 | 15 |
| 123 | HCV 2b | 12 | 92 | 10 | B_3501 | APRSLPHIPV | 5376 | 12 |
| 124 | HCV 2b | 12 | 57 | 10 | B_3501 | TSLDGRPVFL | 5377 | 10 |
| 125 | HCV 2b | 12 | 35 | 9 | B_4403 | SERPCAPGV | 5378 | 24 |
| 126 | HCV 2b | 12 | 35 | 10 | B_4403 | SERPCAPGVW | 5379 | 72 |
| 127 | HCV 2b | 13 | 33 | 10 | A1 | ASEQSLTRLR | 5380 | 13.5 |
| 128 | HCV 2b | 13 | 37 | 9 | A_0201 | SLTRLRPQV | 5381 | 69.55 |
| 129 | HCV 2b | 13 | 24 | 9 | A_0201 | IQWTLPPSL | 5382 | 30.56 |
| 130 | HCV 2b | 13 | 38 | 9 | B7 | LTRLRPQVL | 5383 | 40 |
| 131 | HCV 2b | 13 | 13 | 9 | B7 | APMISSSAT | 5384 | 18 |
| 132 | HCV 2b | 13 | 20 | 9 | B7 | ATSAIQWTL | 5385 | 12 |
| 133 | HCV 2b | 13 | 19 | 11 | B7 | SATSAaIQWTL | 5386 | 12 |
| 134 | HCV 2b | 13 | 23 | 10 | B7 | AIQWTLPPSL | 5387 | 12 |
| 135 | HCV 2b | 13 | 32 | 10 | B7 | LASEQSLTRL | 5388 | 12 |
| 136 | HCV 2b | 13 | 38 | 9 | B8 | LTRLRPQVL | 5389 | 80 |
| 137 | HCV 2b | 13 | 42 | 9 | B_3501 | RPQVLGWWF | 5390 | 40 |
| 138 | HCV 2b | 13 | 7 | 10 | B_4403 | MEAAQPAPMI | 5391 | 12 |
| 139 | HCV 2b | 14 | 5 | 9 | A_0201 | SLFMARLSL | 5392 | 79.04 |
| 140 | HCV 2b | 14 | 4 | 10 | A24 | RSLFmARLSL | 5393 | 12 |
| 141 | HCV 2b | 14 | 2 | 10 | B7 | RARSLFMARL | 5394 | 120 |
| 142 | HCV 2b | 14 | 2 | 10 | B_3501 | RARSLFMARL | 5395 | 18 |
| 143 | HCV 2b | 14 | 4 | 10 | B_3501 | RSLFMARLSL | 5396 | 10 |
| 144 | HCV 2b | 15 | 12 | 9 | A_0201 | SMPSPTTGV | 5397 | 50.23 |
| 145 | HCV 2b | 15 | 3 | 9 | A_0201 | SQQPFGAWA | 5398 | 10.53 |
| 146 | HCV 2b | 15 | 5 | 9 | B7 | QPFGAWASM | 5399 | 20 |
| 147 | HCV 2b | 15 | 19 | 9 | B7 | GVSTsPLYQL | 5400 | 30 |
| 148 | HCV 2b | 15 | 5 | 9 | B_3501 | QPFGAWASM | 5401 | 40 |
| 149 | HCV 2b | 16 | | | | no hits | | |
| 150 | HCV 2b | 17 | 1 | 10 | A_0201 | MMPGQLGTSL | 5402 | 26.23 |
| 151 | HCV 2b | 17 | 2 | 9 | B7 | MPGQLGTSL | 5403 | 80 |
| 152 | HCV 2b | 17 | 2 | 9 | B_3501 | MPGQLGTSL | 5404 | 20 |
| 153 | HCV 2b | 18 | 5 | 10 | B7 | SPRRSKEEIT | 5405 | 20 |
| 154 | HCV 2b | 18 | 5 | 10 | B7 | SPRRSKEEIT | 5406 | 16 |
| 155 | HCV 2b | 18 | 5 | 9 | B_3501 | SPRRSKEEI | 5407 | 24 |
| 156 | HCV 2b | 18 | 8 | 10 | B_3501 | RSKEEITLRI | 5408 | 24 |
| 157 | HCV 2b | 18 | 5 | 9 | B7 | SPRRSKEEI | 5409 | 80.000 |
| 158 | HCV 2b | 19 | 17 | 10 | A3 | LMRWkNAPPK | 5410 | 20 |
| 159 | HCV 2b | 19 | 4 | 10 | A3 | WLWPlTRKSY | 5411 | 15 |
| 160 | HCV 2b | 19 | 29 | 10 | A3 | SLRKGSGWRR | 5412 | 12 |
| 161 | HCV 2b | 19 | 6 | 9 | B7 | WPLTRKSYM | 5413 | 20 |
| 162 | HCV 2b | 19 | 22 | 9 | B7 | NAPPKPPSL | 5414 | 12 |
| 163 | HCV 2b | 19 | 8 | 10 | B7 | LTRKsYMRPL | 5415 | 40 |
| 164 | HCV 2b | 19 | 22 | 9 | B8 | NAPPKPPSL | 5416 | 16 |
| 165 | HCV 2b | 19 | 6 | 9 | B_3501 | WPLTRKSYM | 5417 | 40 |
| 166 | HCV 2b | 20 | 4 | 9 | A_0201 | LLTTWRSLT | 5418 | 12.67 |
| 167 | HCV 2b | 20 | 2 | 10 | B7 | LPLLTTWRSL | 5419 | 80 |
| 168 | HCV 2b | 20 | 2 | 10 | B_3501 | LPLLtTWRSL | 5420 | 20 |
| 169 | HCV 2b | 21 | 6 | 10 | A_0201 | WMPTfSWEAM | 5421 | 13.748 |
| 170 | HCV 2b | 21 | 6 | 9 | A_0201 | WMPTFSWEA | 5422 | 470.387 |
| 171 | HCV 2b | 21 | 7 | 9 | B7 | MPTFSWEAM | 5423 | 20.000 |
| 172 | HCV 2b | 21 | 7 | 9 | B_3501 | MPTFSWEAM | 5424 | 40.000 |

TABLE 4g-continued

2b (1-3)

| No. | Strain | ORF | Start | AA | HLA | Peptide sequence | SEQ ID NO: | Score |
|---|---|---|---|---|---|---|---|---|
| 173 | HCV 2b | 22 | | | | no hits | | |
| 174 | HCV 2b | 23 | 70 | 9 | A1 | QRDPLPLPR | 5425 | 12.500 |
| 175 | HCV 2b | 23 | 91 | 9 | A_0201 | GLQSPIKRI | 5426 | 23.995 |
| 176 | HCV 2b | 23 | 100 | 9 | A_0201 | LLSAAPCHT | 5427 | 12.668 |
| 177 | HCV 2b | 23 | 8 | 9 | A24 | RWQTKCSAL | 5428 | 12.000 |
| 178 | HCV 2b | 23 | 18 | 10 | A24 | KTPMtPVTPL | 5429 | 12.000 |
| 179 | HCV 2b | 23 | 19 | 9 | B7 | TPMTPVTPL | 5430 | 360.000 |
| 180 | HCV 2b | 23 | 80 | 9 | B7 | SVRSSTRTL | 5431 | 200.000 |
| 181 | HCV 2b | 23 | 84 | 9 | B7 | STRTLSRGL | 5432 | 40.000 |
| 182 | HCV 2b | 23 | 35 | 9 | B7 | ASSSPLARL | 5433 | 18.000 |
| 183 | HCV 2b | 23 | 22 | 9 | B7 | TPVTPLGRI | 5434 | 12.000 |
| 184 | HCV 2b | 23 | 55 | 10 | B7 | LPLRgSRGTL | 5435 | 120.000 |
| 185 | HCV 2b | 23 | 46 | 10 | B7 | QMRDhCPPCL | 5436 | 40.000 |
| 186 | HCV 2b | 23 | 59 | 10 | B7 | GSRGtLTWSL | 5437 | 40.000 |
| 187 | HCV 2b | 23 | 76 | 10 | B7 | LPRGsVRSST | 5438 | 30.000 |
| 188 | HCV 2b | 23 | 38 | 10 | B7 | SPLArLPLQM | 5439 | 20.000 |
| 189 | HCV 2b | 23 | 34 | 10 | B7 | TASSsPLARL | 5440 | 18.000 |
| 190 | HCV 2b | 23 | 19 | 9 | B8 | TPMTPVTPL | 5441 | 20.000 |
| 191 | HCV 2b | 23 | 13 | 9 | B8 | CSALSKTPM | 5442 | 10.000 |
| 192 | HCV 2b | 23 | 38 | 10 | B8 | SPLArLPLQM | 5443 | 40.000 |
| 193 | HCV 2b | 23 | 55 | 10 | B8 | LPLRgSRGTL | 5444 | 20.000 |
| 194 | HCV 2b | 23 | 59 | 10 | B8 | GSRGtLTWSL | 5445 | 15.000 |
| 195 | HCV 2b | 24 | 7 | 9 | A_0201 | TLSGLPLRL | 5446 | 21.362 |
| 196 | HCV 2b | 24 | 7 | 10 | A_0201 | TLSGlPLRLV | 5447 | 31.994 |
| 197 | HCV 2b | 24 | 6 | 10 | A24 | RTLSgLPLRL | 5448 | 14.400 |
| 198 | HCV 2b | 24 | 4 | 10 | B7 | SCRTlSGLPL | 5449 | 40.000 |
| 199 | HCV 2b | 24 | 4 | 10 | B8 | SCRTlSGLPL | 5450 | 16.000 |
| 200 | HCV 2b | 25 | 11 | 9 | B_4403 | AEKSQLASS | 5451 | 12.000 |
| 201 | HCV 2b | 25 | 11 | 10 | B_4403 | AEKSqLASSY | 5452 | 360.000 |
| 202 | HCV 2b | 26 | 11 | 10 | A_0201 | SIFSsKLGEV | 5453 | 10.580 |
| 203 | HCV 2b | 27 | 21 | 9 | A_0201 | RLSGNLERL | 5454 | 24.075 |
| 204 | HCV 2b | 27 | 4 | 9 | B7 | TPSHCTHTL | 5455 | 80.000 |
| 205 | HCV 2b | 27 | 4 | 9 | B_3501 | TPSHCTHTL | 5456 | 20.000 |
| 206 | HCV 2b | 27 | 31 | 9 | B_4403 | LERGRVGRV | 5457 | 18.000 |
| 207 | HCV 2b | 28 | 1 | 9 | A1 | MPDPAYYSF | 5458 | 25 |
| 208 | HCV 2b | 28 | 6 | 9 | A24 | YYSFAYSYL | 5459 | 200 |
| 209 | HCV 2b | 28 | 5 | 10 | A24 | AYYSfAYSYL | 5460 | 200 |
| 210 | HCV 2b | 28 | 3 | 9 | B_3501 | DPAYYSFAY | 5461 | 40 |
| 211 | HCV 2b | 28 | 3 | 9 | B_4403 | DPAYYSFAY | 5462 | 27 |
| 212 | HCV 2b | 29 | | | | no hits | | |
| 213 | HCV 2b | 30 | | | | no hits | | |
| 214 | HCV 2b | 31 | 4 | 9 | A1 | DAELVTNSY | 5463 | 45 |
| 215 | HCV 2b | 31 | 41 | 9 | A_0201 | GLFLHAGSV | 5464 | 33.46 |
| 216 | HCV 2b | 31 | 37 | 10 | A_0201 | GIWLGLFLHA | 5465 | 10.77 |
| 217 | HCV 2b | 31 | 32 | 9 | A24 | RPLGCGIWL | 5466 | 12 |
| 218 | HCV 2b | 31 | 32 | 9 | B7 | RPLGCGIWL | 5467 | 80 |
| 219 | HCV 2b | 31 | 25 | 10 | B7 | GPGNCLRRPL | 5468 | 120 |
| 220 | HCV 2b | 31 | 21 | 10 | B7 | CSRVgPGNCL | 5469 | 60.000 |
| 221 | HCV 2b | 31 | 14 | 9 | B8 | DPRLRCSCS | 5470 | 16 |
| 222 | HCV 2b | 31 | 32 | 9 | B_3501 | RPLGCGIWL | 5471 | 40 |
| 223 | HCV 2b | 31 | 25 | 10 | B_3501 | GPGNcLRRPL | 5472 | 20 |
| 224 | HCV 2b | 31 | 21 | 10 | B_3501 | CSRVgPGNCL | 5473 | 15 |
| 225 | HCV 2b | 31 | 4 | 9 | B_4403 | DAELVTNSY | 5474 | 20.25 |
| 226 | HCV 2b | 31 | 3 | 10 | B_4403 | HDAElVTNSY | 5475 | 67.5 |
| 227 | HCV 2b | 32 | 2 | 9 | A24 | RYRPSSVGL | 5476 | 480 |
| 228 | HCV 2b | 32 | 9 | 9 | A3 | GLRAGLLLY | 5477 | 36 |
| 229 | HCV 2b | 32 | 7 | 9 | B7 | SVGLRAGLL | 5478 | 20 |
| 230 | HCV 2b | 32 | 7 | 10 | B7 | SVGLRAGLLL | 5479 | 20 |
| 231 | HCV 2b | 33 | | | | no hits | | |
| 232 | HCV 2b | 34 | | | | no hits | | |
| 233 | HCV 2b | 35 | | | | no hits | | |
| 234 | HCV 2b | 36 | 41 | 9 | A_0201 | GMGGPPFPV | 5480 | 291.35 |
| 235 | HCV 2b | 36 | 1 | 9 | A_0201 | MLLLRPTGT | 5481 | 46.87 |
| 236 | HCV 2b | 36 | 40 | 10 | A_0201 | VGMGgPPFPV | 5482 | 16.56 |
| 237 | HCV 2b | 36 | 33 | 10 | A24 | CYEIHRKVGM | 5483 | 37.5 |
| 238 | HCV 2b | 36 | 50 | 9 | B7 | AGRRQDLCM | 5484 | 30 |
| 239 | HCV 2b | 36 | 47 | 10 | B7 | FPVAGRRQDL | 5485 | 120 |
| 240 | HCV 2b | 36 | 17 | 9 | B_3501 | SPKHRGRAV | 5486 | 12 |
| 241 | HCV 2b | 36 | 25 | 10 | B_3501 | VPLWtFSSCY | 5487 | 40 |
| 242 | HCV 2b | 36 | 34 | 9 | B_4403 | YEIHRKVGM | 5488 | 20 |
| 243 | HCV 2b | 37 | | | | no hits | | |
| 244 | HCV 2b | 38 | | | | no hits | | |
| 245 | HCV 2b | 39 | 14 | 9 | A_0201 | LLPGDRLHL | 5489 | 36.32 |
| 246 | HCV 2b | 39 | 13 | 10 | A_0201 | SLLPGDRLHL | 5490 | 79.04 |
| 247 | HCV 2b | 39 | 19 | 10 | A_0201 | RLHLHHWPHT | 5491 | 12.67 |

TABLE 4g-continued 2b (1-3)

| No. | Strain | ORF | Start | AA | HLA | Peptide sequence | SEQ ID NO: | Score |
|---|---|---|---|---|---|---|---|---|
| 248 | HCV 2b | 39 | 7 | 9 | B7 | GASRRGSLL | 5492 | 12 |
| 249 | HCV 2b | 39 | 7 | 9 | B8 | GASRRGSLL | 5493 | 16 |
| 250 | HCV 2b | 40 | | | | no hits | | |
| 251 | HCV 2b | 41 | 7 | 9 | A_0201 | ILGQTHVEL | 5494 | 36.32 |
| 252 | HCV 2b | 41 | 13 | 9 | A_0201 | VELHQWHTV | 5495 | 14.46 |
| 253 | HCV 2b | 41 | 6 | 10 | A_0201 | TILGqTHVEL | 5496 | 10.87 |
| 254 | HCV 2b | 41 | 20 | 9 | B7 | TVPGGTLHL | 5497 | 20 |
| 255 | HCV 2b | 41 | 31 | 10 | B_3501 | KSRSGINDGF | 5498 | 30 |
| 256 | HCV 2b | 42 | 33 | 9 | A_0201 | QLLHRRALC | 5499 | 18.38 |
| 257 | HCV 2b | 42 | 33 | 10 | A_0201 | QLLHRRALCA | 5500 | 18.38 |
| 258 | HCV 2b | 42 | 29 | 9 | A3 | NLPHQLLHR | 5501 | 12 |
| 259 | HCV 2b | 42 | 34 | 10 | A3 | LLHRrALCAK | 5502 | 30 |
| 260 | HCV 2b | 42 | 22 | 9 | B7 | LPKHVAGNL | 5503 | 80 |
| 261 | HCV 2b | 42 | 27 | 9 | B7 | AGNLPHQLL | 5504 | 18 |
| 262 | HCV 2b | 42 | 26 | 9 | B7 | VAGNLPHQL | 5505 | 12 |
| 263 | HCV 2b | 42 | 25 | 10 | B7 | HVAGnLPHQL | 5506 | 20 |
| 264 | HCV 2b | 42 | 26 | 10 | B7 | VAGNlPHQLL | 5507 | 18 |
| 265 | HCV 2b | 42 | 22 | 9 | B8 | LPKHVAGNL | 5508 | 16 |
| 266 | HCV 2b | 42 | 22 | 9 | B8 | LPKHVAGNL | 5509 | 60 |
| 267 | HCV 2b | 42 | 2 | 10 | B_3501 | RSKHlGPRPL | 5510 | 30 |
| 268 | HCV 2b | 43 | 33 | 9 | A_0201 | QLLHRRALC | 5511 | 18.38 |
| 269 | HCV 2b | 43 | 33 | 10 | A_0201 | QLLHrRALCA | 5512 | 18.38 |
| 270 | HCV 2b | 43 | 29 | 9 | A3 | NLPHQLLHR | 5513 | 12 |
| 271 | HCV 2b | 43 | 34 | 10 | A3 | LLHRRALCAK | 5514 | 30 |
| 272 | HCV 2b | 43 | 22 | 9 | B7 | LPKHVAGNL | 5515 | 80 |
| 273 | HCV 2b | 43 | 27 | 9 | B7 | AGNLPHQLL | 5516 | 18 |
| 274 | HCV 2b | 43 | 26 | 9 | B7 | VAGNLPHQL | 5517 | 12 |
| 275 | HCV 2b | 43 | 25 | 10 | B7 | HVAGnLPHQL | 5518 | 20 |
| 276 | HCV 2b | 43 | 26 | 10 | B7 | VAGNlPHQLL | 5519 | 18 |
| 277 | HCV 2b | 43 | 22 | 9 | B8 | LPKHVAGNL | 5520 | 16 |
| 278 | HCV 2b | 43 | 22 | 9 | B_3501 | LPKHVAGNL | 5521 | 60 |
| 279 | HCV 2b | 43 | 2 | 10 | B_3501 | RSKHlGPRPL | 5522 | 30 |
| 280 | HCV 2b | 44 | | | | no hits | | |
| 281 | HCV 2b | 45 | 2 | 10 | B7 | SVVQpPGPPL | 5523 | 30 |
| 282 | HCV 2b | 45 | 3 | 9 | B7 | VVQPPGPPL | 5524 | 30 |

TABLE 4h 2b (4-6)

| No. | Strain | ORF | Start | AA | HLA | Peptide sequence | SEQ ID NO: | Score |
|---|---|---|---|---|---|---|---|---|
| 1 | HCV 2b | 1 | 2 | 9 | A_0201 | RLTDLSQLA | 5525 | 20.369 |
| 2 | HCV 2b | 1 | 15 | 10 | A1 | KMEPpRKEEK | 5526 | 90.000 |
| 3 | HCV 2b | 1 | 2 | 10 | A_0201 | RLTDLSQLAV | 5527 | 285.163 |
| 4 | HCV 2b | 1 | 15 | 10 | A3 | KMEPpRKEEK | 5528 | 90.000 |
| 5 | HCV 2b | 2 | 13 | 9 | A_0201 | FQLWPAGLV | 5529 | 15.603 |
| 6 | HCV 2b | 2 | 7 | 9 | A_0201 | RQAHVAFQL | 5530 | 12.562 |
| 7 | HCV 2b | 2 | 12 | 9 | A24 | AFQLWPAGL | 5531 | 30.000 |
| 8 | HCV 2b | 2 | 7 | 9 | A24 | RQAHVAFQL | 5532 | 11.200 |
| 9 | HCV 2b | 2 | 3 | 9 | B8 | AMRRRQAHV | 5533 | 12.000 |
| 10 | HCV 2b | 3 | | | | no hits | | |
| 11 | HCV 2b | 4 | | | | no hits | | |
| 12 | HCV 2b | 5 | 21 | 9 | A24 | TFSSWSSTL | 5534 | 20.000 |
| 13 | HCV 2b | 5 | 55 | 9 | A24 | RTQFGSHRL | 5535 | 12.000 |
| 14 | HCV 2b | 5 | 22 | 9 | B_3501 | FSSWSSTLM | 5536 | 10.000 |
| 15 | HCV 2b | 5 | 50 | 9 | B_3501 | RSPWSRTQF | 5537 | 10.000 |
| 16 | HCV 2b | 5 | 17 | 9 | B_3501 | VPVGTFSSW | 5538 | 10.000 |
| 17 | HCV 2b | 5 | 14 | 9 | B_4403 | REVVPVGTF | 5539 | 240.000 |
| 18 | HCV 2b | 5 | 1 | 10 | B7 | MSRSqEGCSL | 5540 | 40.000 |
| 19 | HCV 2b | 5 | 12 | 10 | B7 | GPREvVPVGT | 5541 | 20.000 |
| 20 | HCV 2b | 5 | 30 | 10 | B7 | MVQKaHDHPL | 5542 | 20.000 |
| 21 | HCV 2b | 5 | 1 | 10 | B_3501 | MSRSqEGCSL | 5543 | 22.500 |
| 22 | HCV 2b | 5 | 12 | 10 | B_3501 | GPREvVPVGT | 5544 | 12.000 |
| 23 | HCV 2b | 5 | 14 | 10 | B_4403 | REVVpVGTFS | 5545 | 18.000 |
| 24 | HCV 2b | 6 | | | | no hits | | |
| 25 | HCV 2b | 7 | 1 | 10 | B_3501 | MPLRdFPVRW | 5546 | 10.000 |
| 26 | HCV 2b | 8 | 13 | 9 | A_0201 | VLWPVVGGL | 5547 | 90.126 |
| 27 | HCV 2b | 8 | 5 | 9 | A_0201 | WLAVCPGPV | 5548 | 41.592 |
| 28 | HCV 2b | 8 | 6 | 9 | B7 | LAVCPGPVL | 5549 | 18.000 |
| 29 | HCV 2b | 8 | 13 | 10 | A_0201 | VLWPvVGGLV | 5550 | 127.579 |

TABLE 4h-continued

2b (4-6)

| No. | Strain | ORF | Start | AA | HLA | Peptide sequence | SEQ ID NO: | Score |
|---|---|---|---|---|---|---|---|---|
| 30 | HCV 2b | 8 | 5 | 10 | A_0201 | WLAVcPGPVL | 5551 | 40.289 |
| 31 | HCV 2b | 8 | 8 | 10 | A_0201 | VCPGpVLWPV | 5552 | 13.314 |
| 32 | HCV 2b | 9 | 10 | 9 | B7 | APSQFSLYV | 5553 | 12.000 |
| 33 | HCV 2b | 9 | 9 | 10 | A_0201 | IAPSqFSLYV | 5554 | 34.322 |
| 34 | HCV 2b | 9 | 7 | 10 | B7 | CPIApSQFSL | 5555 | 80.000 |
| 35 | HCV 2b | 9 | 7 | 10 | B_3501 | CPIApSQFSL | 5556 | 20.000 |
| 36 | HCV 2b | 10 | 10 | 9 | A24 | RYLSVRAGS | 5557 | 21.000 |
| 37 | HCV 2b | 10 | 26 | 9 | A3 | QLVACCCQK | 5558 | 30.000 |
| 38 | HCV 2b | 10 | 4 | 9 | B7 | GPWCSSRYL | 5559 | 80.000 |
| 39 | HCV 2b | 10 | 4 | 9 | B_3501 | GPWCSSRYL | 5560 | 20.000 |
| 40 | HCV 2b | 10 | 18 | 10 | B7 | SPPGkFGAQL | 5561 | 80.000 |
| 41 | HCV 2b | 10 | 18 | 10 | B_3501 | SPPGkFGAQL | 5562 | 20.000 |
| 42 | HCV 2b | 11 | | | | no hits | | |
| 43 | HCV 2b | 12 | | | | no hits | | |
| 44 | HCV 2b | 13 | | | | no hits | | |
| 45 | HCV 2b | 14 | 2 | 9 | B7 | WPRGPLCPL | 5563 | 1.200.000 |
| 46 | HCV 2b | 14 | 2 | 9 | B8 | WPRGPLCPL | 5564 | 16.000 |
| 47 | HCV 2b | 14 | 2 | 9 | B_3501 | WPRGPLCPL | 5565 | 60.000 |
| 48 | HCV 2b | 15 | | | | no hits | | |
| 49 | HCV 2b | 16 | 20 | 9 | A24 | PYLPICSGL | 5566 | 50.400 |
| 50 | HCV 2b | 16 | 11 | 9 | B_3501 | AAVDSADPY | 5567 | 12.000 |
| 51 | HCV 2b | 16 | 14 | 9 | B_3501 | DSADPYPYL | 5568 | 10.000 |
| 52 | HCV 2b | 16 | 11 | 9 | B_4403 | AAVDSADPY | 5569 | 18.000 |
| 53 | HCV 2b | 16 | 13 | 9 | B_4403 | VDSADPYPY | 5570 | 15.000 |
| 54 | HCV 2b | 16 | 12 | 10 | A1 | AVDSaDPYPY | 5571 | 50.000 |
| 55 | HCV 2b | 16 | 15 | 10 | A1 | SADPyPYLPI | 5572 | 25.000 |
| 56 | HCV 2b | 16 | 21 | 10 | A_0201 | YLPicSGLRV | 5573 | 319.939 |
| 57 | HCV 2b | 16 | 19 | 10 | B7 | YPYLpICSGL | 5574 | 80.000 |
| 58 | HCV 2b | 16 | 19 | 10 | B_3501 | YPYLpICSGL | 5575 | 20.000 |
| 59 | HCV 2b | 16 | 10 | 10 | B_4403 | SAAVdSADPY | 5576 | 18.000 |
| 60 | HCV 2b | 17 | 2 | 10 | B7 | LQRIyAPPPL | 5577 | 40.000 |
| 61 | HCV 2b | 18 | 3 | 9 | B7 | NATVCKGSL | 5578 | 12.000 |
| 62 | HCV 2b | 18 | 10 | 10 | A3 | SLSGtWGSTR | 5579 | 18.000 |
| 63 | HCV 2b | 19 | 6 | 9 | B7 | NASSTASCL | 5580 | 12.000 |
| 64 | HCV 2b | 20 | | | | no hits | | |
| 65 | HCV 2b | 21 | 8 | 9 | A1 | GLEAVRHSY | 5581 | 45.000 |
| 66 | HCV 2b | 21 | 8 | 9 | A3 | GLEAVRHSY | 5582 | 18.000 |
| 67 | HCV 2b | 21 | 1 | 9 | B7 | MALPGGGGL | 5583 | 12.000 |
| 68 | HCV 2b | 22 | 2 | 10 | B7 | ICREtSYGTL | 5584 | 40.000 |
| 69 | HCV 2b | 22 | 2 | 10 | B8 | ICREtSYGTL | 5585 | 24.000 |
| 70 | HCV 2b | 23 | | | | no hits | | |
| 71 | HCV 2b | 24 | 24 | 9 | A_0201 | VSLSFVFTA | 5586 | 10.340 |
| 72 | HCV 2b | 24 | 18 | 9 | B7 | LASGNGVSL | 5587 | 12.000 |
| 73 | HCV 2b | 24 | 25 | 10 | A_0201 | SLSFvFTAQL | 5588 | 81.177 |
| 74 | HCV 2b | 24 | 23 | 10 | A_0201 | GVSLsFVFTA | 5589 | 22.036 |
| 75 | HCV 2b | 24 | 17 | 10 | A_0201 | RLASgNGVSL | 5590 | 21.362 |
| 76 | HCV 2b | 25 | 100 | 9 | A_0201 | WMMLPSQEL | 5591 | 262.591 |
| 77 | HCV 2b | 25 | 88 | 9 | A_0201 | IMTIRTQIV | 5592 | 35.012 |
| 78 | HCV 2b | 25 | 51 | 9 | A_0201 | IMAGRSSGL | 5593 | 26.228 |
| 79 | HCV 2b | 25 | 168 | 9 | A_0201 | YLVIASVKA | 5594 | 22.853 |
| 80 | HCV 2b | 25 | 101 | 9 | A_0201 | MMLPSQELT | 5595 | 16.588 |
| 81 | HCV 2b | 25 | 121 | 9 | A_0201 | VIGVVGSLV | 5596 | 16.258 |
| 82 | HCV 2b | 25 | 116 | 9 | A_0201 | SQAARVIGV | 5597 | 16.219 |
| 83 | HCV 2b | 25 | 68 | 9 | A_0201 | SKLRFWFRV | 5598 | 13.392 |
| 84 | HCV 2b | 25 | 120 | 9 | A24 | RVIGVVGSL | 5599 | 16.800 |
| 85 | HCV 2b | 25 | 161 | 9 | A24 | RSPGGAEYL | 5600 | 12.000 |
| 86 | HCV 2b | 25 | 131 | 9 | A24 | KYRRRPRES | 5601 | 11.000 |
| 87 | HCV 2b | 25 | 58 | 9 | A3 | GLTEYTAPY | 5602 | 54.000 |
| 88 | HCV 2b | 25 | 123 | 9 | A3 | GVVGSLVKK | 5603 | 20.250 |
| 89 | HCV 2b | 25 | 208 | 9 | B7 | AALHAARAL | 5604 | 36.000 |
| 90 | HCV 2b | 25 | 120 | 9 | B7 | RVIGVVGSL | 5605 | 20.000 |
| 91 | HCV 2b | 25 | 95 | 9 | B7 | IVGAYWMML | 5606 | 20.000 |
| 92 | HCV 2b | 25 | 169 | 9 | B7 | LVIASVKAL | 5607 | 20.000 |
| 93 | HCV 2b | 25 | 4 | 9 | B7 | EALTARARL | 5608 | 18.000 |
| 94 | HCV 2b | 25 | 100 | 9 | B7 | WMMLPSQEL | 5609 | 18.000 |
| 95 | HCV 2b | 25 | 7 | 9 | B8 | TARARLFHA | 5610 | 16.000 |
| 96 | HCV 2b | 25 | 64 | 9 | B_3501 | APYISKLRF | 5611 | 20.000 |
| 97 | HCV 2b | 25 | 180 | 9 | B_3501 | RSSSSLPWL | 5612 | 10.000 |
| 98 | HCV 2b | 25 | 161 | 9 | B_3501 | RSPGGAEYL | 5613 | 10.000 |
| 99 | HCV 2b | 25 | 183 | 9 | B_3501 | SSLPWLSEM | 5614 | 10.000 |
| 100 | HCV 2b | 25 | 44 | 9 | B_3501 | SSPCSLSIM | 5615 | 10.000 |
| 101 | HCV 2b | 25 | 137 | 9 | B_4403 | RESSATDTF | 5616 | 90.000 |
| 102 | HCV 2b | 25 | 148 | 9 | B_4403 | QDVISSKSY | 5617 | 67.500 |
| 103 | HCV 2b | 25 | 82 | 9 | B_4403 | MEKKWVIMT | 5618 | 12.000 |

TABLE 4h-continued

2b (4-6)

| No. | Strain | ORF | Start | AA | HLA | Peptide sequence | SEQ ID NO: | Score |
|---|---|---|---|---|---|---|---|---|
| 104 | HCV 2b | 25 | 166 | 9 | B_4403 | AEYLVIASV | 5619 | 12.000 |
| 105 | HCV 2b | 25 | 110 | 9 | B_4403 | GECLTVSQA | 5620 | 12.000 |
| 106 | HCV 2b | 25 | 145 | 9 | B_4403 | FEEQDVISS | 5621 | 12.000 |
| 107 | HCV 2b | 25 | 2 | 10 | A1 | MSEAlTARAR | 5622 | 13.500 |
| 108 | HCV 2b | 25 | 58 | 10 | A_0201 | GLTEyTAPYI | 5623 | 235.260 |
| 109 | HCV 2b | 25 | 168 | 10 | A_0201 | YLVIaSVKAL | 5624 | 226.014 |
| 110 | HCV 2b | 25 | 112 | 10 | A_0201 | CLTVsQAARV | 5625 | 69.552 |
| 111 | HCV 2b | 25 | 100 | 10 | A_0201 | WMMLpSQELT | 5626 | 44.885 |
| 112 | HCV 2b | 25 | 1 | 10 | A_0201 | MMSEaLTARA | 5627 | 25.008 |
| 113 | HCV 2b | 25 | 87 | 10 | A_0201 | VIMTiRTQIV | 5628 | 24.663 |
| 114 | HCV 2b | 25 | 78 | 10 | A_0201 | WASSmEKKWV | 5629 | 24.440 |
| 115 | HCV 2b | 25 | 50 | 10 | A_0201 | SIMAgRSSGL | 5630 | 10.868 |
| 116 | HCV 2b | 25 | 61 | 10 | A24 | EYTApYISKL | 5631 | 220.000 |
| 117 | HCV 2b | 25 | 65 | 10 | A24 | PYISkLRFWF | 5632 | 18.000 |
| 118 | HCV 2b | 25 | 131 | 10 | A24 | KYRRrPRESS | 5633 | 10.000 |
| 119 | HCV 2b | 25 | 176 | 10 | B7 | ALRFrSSSSL | 5634 | 120.000 |
| 120 | HCV 2b | 25 | 15 | 10 | B7 | ALRGgAPSFL | 5635 | 120.000 |
| 121 | HCV 2b | 25 | 7 | 10 | B7 | TARArLFHAL | 5636 | 120.000 |
| 122 | HCV 2b | 25 | 201 | 10 | B7 | IVGStIPAAL | 5637 | 20.000 |
| 123 | HCV 2b | 25 | 135 | 10 | B7 | RPREsSATDT | 5638 | 20.000 |
| 124 | HCV 2b | 25 | 208 | 10 | B7 | AALHaARALM | 5639 | 13.500 |
| 125 | HCV 2b | 25 | 50 | 10 | B7 | SIMAgRSSGL | 5640 | 12.000 |
| 126 | HCV 2b | 25 | 7 | 10 | B8 | TARArLFHAL | 5641 | 16.000 |
| 127 | HCV 2b | 25 | 135 | 10 | B_3501 | RPREsSATDT | 5642 | 24.000 |
| 128 | HCV 2b | 25 | 80 | 10 | B_3501 | SSMEkKWVIM | 5643 | 20.000 |
| 129 | HCV 2b | 25 | 28 | 10 | B_3501 | ATREsSWGEY | 5644 | 12.000 |
| 130 | HCV 2b | 25 | 162 | 10 | B_3501 | SPGGaEYLVI | 5645 | 12.000 |
| 131 | HCV 2b | 25 | 64 | 10 | B_3501 | APYIsKLRFW | 5646 | 10.000 |
| 132 | HCV 2b | 25 | 182 | 10 | B_3501 | SSSLpWLSEM | 5647 | 10.000 |
| 133 | HCV 2b | 25 | 43 | 10 | B_3501 | ASSPcSLSIM | 5648 | 10.000 |
| 134 | HCV 2b | 25 | 3 | 10 | B_4403 | SEALtARARL | 5649 | 24.000 |
| 135 | HCV 2b | 25 | 57 | 10 | B_4403 | SGLTeYTAPY | 5650 | 18.000 |
| 136 | HCV 2b | 25 | 53 | 10 | B_4403 | AGRSsGLTEY | 5651 | 13.500 |
| 137 | HCV 2b | 26 | 9 | 9 | A24 | KTPLARQRL | 5652 | 14.400 |
| 138 | HCV 2b | 26 | 1 | 9 | A3 | MVFPMLVVK | 5653 | 22.500 |
| 139 | HCV 2b | 26 | 5 | 10 | A3 | MLVVkTPLAR | 5654 | 12.000 |
| 140 | HCV 2b | 26 | 3 | 10 | B7 | FPMLvVKTPL | 5655 | 240.000 |
| 141 | HCV 2b | 26 | 3 | 10 | B_3501 | FPMLvVKTPL | 5656 | 20.000 |
| 142 | HCV 2b | 27 | 5 | 9 | A_0201 | VLMSLSVTV | 5657 | 437.482 |
| 143 | HCV 2b | 27 | 21 | 9 | A_0201 | YENPIGSFL | 5658 | 10.509 |
| 144 | HCV 2b | 27 | 20 | 9 | A24 | SYENPIGSF | 5659 | 150.000 |
| 145 | HCV 2b | 27 | 8 | 9 | A3 | SLSVTVESK | 5660 | 60.000 |
| 146 | HCV 2b | 27 | 28 | 9 | A3 | FLLPQALRR | 5661 | 18.000 |
| 147 | HCV 2b | 27 | 37 | 9 | B_3501 | KSTRSAGEY | 5662 | 20.000 |
| 148 | HCV 2b | 27 | 13 | 9 | B_4403 | VESKQRVSY | 5663 | 120.000 |
| 149 | HCV 2b | 27 | 12 | 10 | A1 | TVESkQRVSY | 5664 | 90.000 |
| 150 | HCV 2b | 27 | 4 | 10 | A_0201 | SVLMsLSVTV | 5665 | 22.517 |
| 151 | HCV 2b | 27 | 21 | 10 | A_0201 | YENPiGSFLL | 5666 | 11.082 |
| 152 | HCV 2b | 27 | 20 | 10 | A24 | SYENpIGSFL | 5667 | 420.000 |
| 153 | HCV 2b | 27 | 19 | 10 | B_3501 | VSYEnPIGSF | 5668 | 10.000 |
| 154 | HCV 2b | 27 | 21 | 10 | B_4403 | YENPiGSFLL | 5669 | 12.000 |
| 155 | HCV 2b | 28 | 43 | 9 | A_0201 | WLTAPLDKL | 5670 | 110.747 |
| 156 | HCV 2b | 28 | 19 | 9 | A_0201 | FLAMAVVSI | 5671 | 110.379 |
| 157 | HCV 2b | 28 | 21 | 9 | A_0201 | AMAVVSIGV | 5672 | 50.232 |
| 158 | HCV 2b | 28 | 81 | 9 | A_0201 | ALTLEAARL | 5673 | 21.362 |
| 159 | HCV 2b | 28 | 6 | 9 | A24 | FFPPLAGSI | 5674 | 10.800 |
| 160 | HCV 2b | 28 | 55 | 9 | B7 | FAPNPYRDL | 5675 | 18.000 |
| 161 | HCV 2b | 28 | 72 | 9 | B7 | QASSTERSL | 5676 | 12.000 |
| 162 | HCV 2b | 28 | 81 | 9 | B7 | ALTLEAARL | 5677 | 12.000 |
| 163 | HCV 2b | 28 | 58 | 9 | B_3501 | NPYRDLAEW | 5678 | 15.000 |
| 164 | HCV 2b | 28 | 74 | 9 | B_3501 | SSTERSLAL | 5679 | 10.000 |
| 165 | HCV 2b | 28 | 84 | 9 | B_4403 | LEAARLTSC | 5680 | 18.000 |
| 166 | HCV 2b | 28 | 54 | 10 | A24 | SFAPnPYRDL | 5681 | 24.000 |
| 167 | HCV 2b | 28 | 41 | 10 | A3 | RMWLtAPLDK | 5682 | 200.000 |
| 168 | HCV 2b | 28 | 71 | 10 | B7 | AQASsTERSL | 5683 | 12.000 |
| 169 | HCV 2b | 28 | 11 | 10 | B7 | AGSIqNTSFL | 5684 | 12.000 |
| 170 | HCV 2b | 28 | 80 | 10 | B7 | LALTlEAARL | 5685 | 12.000 |
| 171 | HCV 2b | 28 | 73 | 10 | B7 | ASSTeRSLAL | 5686 | 12.000 |
| 172 | HCV 2b | 28 | 46 | 10 | B_3501 | APLDkLRTSF | 5687 | 40.000 |
| 173 | HCV 2b | 28 | 35 | 10 | B_3501 | RSSHtDRMWL | 5688 | 15.000 |
| 174 | HCV 2b | 28 | 64 | 10 | B_4403 | AEWGgVNAQA | 5689 | 18.000 |
| 175 | HCV 2b | 29 | 2 | 9 | B_3501 | RAPVQEYDM | 5690 | 12.000 |
| 176 | HCV 2b | 30 | 5 | 9 | B7 | SPSEGGADL | 5691 | 80.000 |
| 177 | HCV 2b | 30 | 5 | 9 | B_3501 | SPSEGGADL | 5692 | 40.000 |

TABLE 4h-continued

2b (4-6)

| No. | Strain | ORF | Start | AA | HLA | Peptide sequence | SEQ ID NO: | Score |
|---|---|---|---|---|---|---|---|---|
| 178 | HCV 2b | 30 | 42 | 9 | B_3501 | VSPEGCWTL | 5693 | 10.000 |
| 179 | HCV 2b | 30 | 33 | 10 | A1 | DSDPaSEAAV | 5694 | 15.000 |
| 180 | HCV 2b | 30 | 49 | 10 | A_0201 | TLSPpVSAPV | 5695 | 69.552 |
| 181 | HCV 2b | 30 | 41 | 10 | A_0201 | AVSPeGCWTL | 5696 | 14.019 |
| 182 | HCV 2b | 30 | 41 | 10 | B7 | AVSPeGCWTL | 5697 | 60.000 |
| 183 | HCV 2b | 30 | 22 | 10 | B7 | SPGSpSRGGM | 5698 | 30.000 |
| 184 | HCV 2b | 30 | 22 | 10 | B_3501 | SPGSpSRGGM | 5699 | 40.000 |
| 185 | HCV 2b | 30 | 7 | 10 | B_4403 | SEGGaDLAGS | 5700 | 18.000 |
| 186 | HCV 2b | 30 | 38 | 10 | B_4403 | SEAAvSPEGC | 5701 | 16.000 |
| 187 | HCV 2b | 31 | 74 | 9 | A_0201 | VMWDGSVNM | 5702 | 207.569 |
| 188 | HCV 2b | 31 | 31 | 9 | A_0201 | SQSYAVLWV | 5703 | 89.205 |
| 189 | HCV 2b | 31 | 80 | 9 | A_0201 | VNMEANTSV | 5704 | 11.709 |
| 190 | HCV 2b | 31 | 32 | 9 | A_0201 | QSYAVLWVV | 5705 | 10.275 |
| 191 | HCV 2b | 31 | 34 | 9 | A_0201 | YAVLWVVQV | 5706 | 10.220 |
| 192 | HCV 2b | 31 | 36 | 9 | A3 | VLWVVQVAF | 5707 | 15.000 |
| 193 | HCV 2b | 31 | 56 | 9 | B7 | LACEGGDPL | 5708 | 12.000 |
| 194 | HCV 2b | 31 | 15 | 9 | B7 | SIRVTSPPM | 5709 | 10.000 |
| 195 | HCV 2b | 31 | 31 | 10 | A_0201 | SQSYaVLWVV | 5710 | 49.874 |
| 196 | HCV 2b | 31 | 9 | 10 | A_0201 | ITLEsDSIRV | 5711 | 24.912 |
| 197 | HCV 2b | 31 | 43 | 10 | A24 | AFKDgADSWL | 5712 | 24.000 |
| 198 | HCV 2b | 31 | 36 | 10 | A3 | VLWVvQVAFK | 5713 | 300.000 |
| 199 | HCV 2b | 31 | 73 | 10 | B7 | AVMWdGSVNM | 5714 | 45.000 |
| 200 | HCV 2b | 31 | 2 | 10 | B7 | ESREsRTITL | 5715 | 40.000 |
| 201 | HCV 2b | 31 | 17 | 10 | B7 | RVTSpPMKRL | 5716 | 30.000 |
| 202 | HCV 2b | 31 | 28 | 10 | B7 | STMSqSYAVL | 5717 | 12.000 |
| 203 | HCV 2b | 31 | 2 | 10 | B8 | ESREsRTITL | 5718 | 240.000 |
| 204 | HCV 2b | 31 | 2 | 10 | B_3501 | ESREsRTITL | 5719 | 30.000 |
| 205 | HCV 2b | 31 | 14 | 10 | B_3501 | DSIRvTSPPM | 5720 | 10.000 |
| 206 | HCV 2b | 32 | 103 | 9 | A_0201 | SLLSKLVIV | 5721 | 242.674 |
| 207 | HCV 2b | 32 | 110 | 9 | A_0201 | IVSELNTCV | 5722 | 42.418 |
| 208 | HCV 2b | 32 | 11 | 9 | A_0201 | QVFGPVIFM | 5723 | 20.346 |
| 209 | HCV 2b | 32 | 30 | 9 | B7 | APHEHRVVM | 5724 | 90.000 |
| 210 | HCV 2b | 32 | 39 | 9 | B7 | TPVPAHTPL | 5725 | 80.000 |
| 211 | HCV 2b | 32 | 20 | 9 | B7 | VPKRTWPEM | 5726 | 20.000 |
| 212 | HCV 2b | 32 | 97 | 9 | B7 | SVIQACSLL | 5727 | 20.000 |
| 213 | HCV 2b | 32 | 100 | 9 | B7 | QACSLLSKL | 5728 | 12.000 |
| 214 | HCV 2b | 32 | 53 | 9 | B8 | EMKGRPGIL | 5729 | 160.000 |
| 215 | HCV 2b | 32 | 20 | 9 | B_3501 | VPKRTWPEM | 5730 | 120.000 |
| 216 | HCV 2b | 32 | 30 | 9 | B_3501 | APHEHRVVM | 5731 | 80.000 |
| 217 | HCV 2b | 32 | 57 | 9 | B_3501 | RPGILGSNF | 5732 | 40.000 |
| 218 | HCV 2b | 32 | 39 | 9 | B_3501 | TPVPAHTPL | 5733 | 20.000 |
| 219 | HCV 2b | 32 | 111 | 10 | A1 | VSELnTCVTR | 5734 | 27.000 |
| 220 | HCV 2b | 32 | 11 | 10 | A_0201 | QVFGpVIFMV | 5735 | 300.383 |
| 221 | HCV 2b | 32 | 107 | 10 | A_0201 | KLVIvSELNT | 5736 | 26.082 |
| 222 | HCV 2b | 32 | 109 | 10 | A_0201 | VIVSeLNTCV | 5737 | 16.258 |
| 223 | HCV 2b | 32 | 65 | 10 | A_0201 | FADSqFLKSV | 5738 | 15.535 |
| 224 | HCV 2b | 32 | 27 | 10 | A_0201 | EMFApHEHRV | 5739 | 13.939 |
| 225 | HCV 2b | 32 | 46 | 10 | A3 | PLYPfWQEMK | 5740 | 45.000 |
| 226 | HCV 2b | 32 | 45 | 10 | B7 | TPLYpFWQEM | 5741 | 20.000 |
| 227 | HCV 2b | 32 | 20 | 10 | B_3501 | VPKRtWPEMF | 5742 | 60.000 |
| 228 | HCV 2b | 32 | 45 | 10 | B_3501 | TPLYpFWQEM | 5743 | 40.000 |
| 229 | HCV 2b | 32 | 39 | 10 | B_3501 | TPVPaHTPLY | 5744 | 40.000 |
| 230 | HCV 2b | 32 | 41 | 10 | B_3501 | VPAHtPLYPF | 5745 | 20.000 |
| 231 | HCV 2b | 32 | 4 | 10 | B_3501 | VPCHmFRQVF | 5746 | 20.000 |
| 232 | HCV 2b | 32 | 105 | 10 | B_3501 | LSKLvIVSEL | 5747 | 15.000 |
| 233 | HCV 2b | 32 | 67 | 10 | B_3501 | DSQFlKSVRM | 5748 | 10.000 |
| 234 | HCV 2b | 32 | 112 | 10 | B_4403 | SELNtCVTRS | 5749 | 72.000 |
| 235 | HCV 2b | 32 | 39 | 10 | B_4403 | TPVPaHTPLY | 5750 | 18.000 |
| 236 | HCV 2b | 33 | 86 | 9 | A_0201 | MMFKRMVVL | 5751 | 91.513 |
| 237 | HCV 2b | 33 | 147 | 9 | A_0201 | CMAGCMSWA | 5752 | 45.388 |
| 238 | HCV 2b | 33 | 51 | 9 | A_0201 | ILPRPILPT | 5753 | 29.137 |
| 239 | HCV 2b | 33 | 125 | 9 | A_0201 | CMPLMKFHM | 5754 | 20.810 |
| 240 | HCV 2b | 33 | 11 | 9 | A_0201 | KIAGRRFTT | 5755 | 20.800 |
| 241 | HCV 2b | 33 | 166 | 9 | A_0201 | ILDLSISAI | 5756 | 16.317 |
| 242 | HCV 2b | 33 | 165 | 9 | A_0201 | SILDLSISA | 5757 | 10.363 |
| 243 | HCV 2b | 33 | 123 | 9 | A24 | RYCMPLMKF | 5758 | 220.000 |
| 244 | HCV 2b | 33 | 176 | 9 | B7 | CPSSMRAAL | 5759 | 120.000 |
| 245 | HCV 2b | 33 | 120 | 9 | B7 | SPARYCMPL | 5760 | 80.000 |
| 246 | HCV 2b | 33 | 91 | 9 | B7 | MVVLVGSGL | 5761 | 20.000 |
| 247 | HCV 2b | 33 | 52 | 9 | B7 | LPRPILPTA | 5762 | 20.000 |
| 248 | HCV 2b | 33 | 83 | 9 | B7 | HPPMMFKRM | 5763 | 20.000 |
| 249 | HCV 2b | 33 | 44 | 9 | B7 | PARTSTNIL | 5764 | 12.000 |
| 250 | HCV 2b | 33 | 159 | 9 | B7 | ACCRRPSIL | 5765 | 12.000 |
| 251 | HCV 2b | 33 | 159 | 9 | B8 | ACCRRPSIL | 5766 | 16.000 |

TABLE 4h-continued

2b (4-6)

| No. | Strain | ORF | Start | AA | HLA | Peptide sequence | SEQ ID NO: | Score |
|---|---|---|---|---|---|---|---|---|
| 252 | HCV 2b | 33 | 83 | 9 | B_3501 | HPPMMFKRM | 5767 | 40.000 |
| 253 | HCV 2b | 33 | 35 | 9 | B_3501 | RAPEMPAPY | 5768 | 24.000 |
| 254 | HCV 2b | 33 | 120 | 9 | B_3501 | SPARYCMPL | 5769 | 20.000 |
| 255 | HCV 2b | 33 | 176 | 9 | B_3501 | CPSSMRAAL | 5770 | 20.000 |
| 256 | HCV 2b | 33 | 163 | 9 | B_3501 | RPSILDLSI | 5771 | 16.000 |
| 257 | HCV 2b | 33 | 20 | 9 | B_3501 | SSTEGFSPL | 5772 | 10.000 |
| 258 | HCV 2b | 33 | 188 | 9 | B_3501 | SSISSKASY | 5773 | 10.000 |
| 259 | HCV 2b | 33 | 188 | 9 | B_4403 | SSISSKASY | 5774 | 30.000 |
| 260 | HCV 2b | 33 | 118 | 9 | B_4403 | VESPARYCM | 5775 | 12.000 |
| 261 | HCV 2b | 33 | 9 | 9 | B_4403 | GDKIAGRRF | 5776 | 11.250 |
| 262 | HCV 2b | 33 | 21 | 10 | A1 | STEGfSPLMI | 5777 | 11.250 |
| 263 | HCV 2b | 33 | 166 | 10 | A1 | ILDLsISAIR | 5778 | 10.000 |
| 264 | HCV 2b | 33 | 86 | 10 | A_0201 | MMFKrMVVLV | 5779 | 726.706 |
| 265 | HCV 2b | 33 | 165 | 10 | A_0201 | SILDlSISAI | 5780 | 50.051 |
| 266 | HCV 2b | 33 | 147 | 10 | A_0201 | CMAGcMSWAC | 5781 | 26.910 |
| 267 | HCV 2b | 33 | 98 | 10 | A_0201 | GLVNaALKAI | 5782 | 23.995 |
| 268 | HCV 2b | 33 | 77 | 10 | A_0201 | AIWEaNHPPM | 5783 | 23.246 |
| 269 | HCV 2b | 33 | 51 | 10 | A_0201 | ILPRpILPTA | 5784 | 19.425 |
| 270 | HCV 2b | 33 | 93 | 10 | A_0201 | VLVGsGLVNA | 5785 | 19.425 |
| 271 | HCV 2b | 33 | 90 | 10 | A_0201 | RMVVlVGSGL | 5786 | 15.428 |
| 272 | HCV 2b | 33 | 16 | 10 | A24 | RFTTsSTEGF | 5787 | 20.000 |
| 273 | HCV 2b | 33 | 90 | 10 | A24 | RMVVlVGSGL | 5788 | 16.800 |
| 274 | HCV 2b | 33 | 175 | 10 | A24 | RCPSsMRAAL | 5789 | 12.000 |
| 275 | HCV 2b | 33 | 57 | 10 | B7 | LPTAaPTRPL | 5790 | 120.000 |
| 276 | HCV 2b | 33 | 126 | 10 | B7 | MPLMkFHMCL | 5791 | 80.000 |
| 277 | HCV 2b | 33 | 43 | 10 | B7 | YPARtSTNIL | 5792 | 80.000 |
| 278 | HCV 2b | 33 | 160 | 10 | B7 | CCRRpSILDL | 5793 | 40.000 |
| 279 | HCV 2b | 33 | 52 | 10 | B7 | LPRPiLPTAA | 5794 | 20.000 |
| 280 | HCV 2b | 33 | 120 | 10 | B7 | SPARyCMPLM | 5795 | 20.000 |
| 281 | HCV 2b | 33 | 158 | 10 | B7 | VACCrRPSIL | 5796 | 12.000 |
| 282 | HCV 2b | 33 | 30 | 10 | B8 | ILKAtRAPEM | 5797 | 40.000 |
| 283 | HCV 2b | 33 | 158 | 10 | B8 | VACCrRPSIL | 5798 | 16.000 |
| 284 | HCV 2b | 33 | 160 | 10 | B8 | CCRRpSILDL | 5799 | 16.000 |
| 285 | HCV 2b | 33 | 120 | 10 | B_3501 | SPARyCMPLM | 5800 | 40.000 |
| 286 | HCV 2b | 33 | 43 | 10 | B_3501 | YPARtSTNIL | 5801 | 20.000 |
| 287 | HCV 2b | 33 | 57 | 10 | B_3501 | LPTAaPTRPL | 5802 | 20.000 |
| 288 | HCV 2b | 33 | 126 | 10 | B_3501 | MPLMkFHMCL | 5803 | 20.000 |
| 289 | HCV 2b | 33 | 20 | 10 | B_3501 | SSTEgFSPLM | 5804 | 20.000 |
| 290 | HCV 2b | 33 | 69 | 10 | B_3501 | KPVApAGGAI | 5805 | 16.000 |
| 291 | HCV 2b | 33 | 191 | 10 | B_3501 | SSKAsYKISL | 5806 | 15.000 |
| 292 | HCV 2b | 33 | 139 | 10 | B_3501 | CSILgHDDCM | 5807 | 10.000 |
| 293 | HCV 2b | 33 | 171 | 10 | B_3501 | ISAIrCPSSM | 5808 | 10.000 |
| 294 | HCV 2b | 33 | 187 | 10 | B_3501 | HSSIsSKASY | 5809 | 10.000 |
| 295 | HCV 2b | 33 | 79 | 10 | B_4403 | WEANhPPMMF | 5810 | 80.000 |
| 296 | HCV 2b | 33 | 105 | 10 | B_4403 | KAIIdATAGF | 5811 | 16.875 |
| 297 | HCV 2b | 34 | 2 | 9 | B7 | RPMMEMQPV | 5812 | 12.000 |
| 298 | HCV 2b | 34 | 2 | 9 | B_3501 | RPMMEMQPV | 5813 | 12.000 |
| 299 | HCV 2b | 35 | 7 | 9 | A_0201 | CMHVAIYFV | 5814 | 635.435 |
| 300 | HCV 2b | 35 | 11 | 9 | A_0201 | AIYFVTGWV | 5815 | 21.881 |
| 301 | HCV 2b | 35 | 30 | 9 | A24 | RYRRGVGPV | 5816 | 10.000 |
| 302 | HCV 2b | 35 | 36 | 9 | B7 | GPVSVGFSL | 5817 | 80.000 |
| 303 | HCV 2b | 35 | 27 | 9 | B7 | APKRYRRGV | 5818 | 18.000 |
| 304 | HCV 2b | 35 | 36 | 9 | B_3501 | GPVSVGFSL | 5819 | 20.000 |
| 305 | HCV 2b | 35 | 27 | 9 | B_3501 | APKRYRRGV | 5820 | 12.000 |
| 306 | HCV 2b | 35 | 51 | 9 | B_3501 | TSHEGGGAF | 5821 | 10.000 |
| 307 | HCV 2b | 35 | 6 | 10 | A_0201 | ACMHvAIYFV | 5822 | 21.250 |
| 308 | HCV 2b | 35 | 7 | 10 | A_0201 | CMHVaIYFVT | 5823 | 19.198 |
| 309 | HCV 2b | 35 | 30 | 10 | A24 | RYRRgVGPVS | 5824 | 14.000 |
| 310 | HCV 2b | 35 | 4 | 10 | B_3501 | RSACmHVAIY | 5825 | 20.000 |
| 311 | HCV 2b | 35 | 22 | 10 | B_3501 | ISLVtAPKRY | 5826 | 10.000 |
| 312 | HCV 2b | 35 | 4 | 10 | B_4403 | RSACmHVAIY | 5827 | 18.000 |
| 313 | HCV 2b | 35 | 22 | 10 | B_4403 | ISLVtAPKRY | 5828 | 13.500 |
| 314 | HCV 2b | 36 | | | | no hits | | |
| 315 | HCV 2b | 37 | | | | no hits | | |
| 316 | HCV 2b | 38 | 1 | 9 | A1 | MTESKSPVY | 5829 | 225.000 |
| 317 | HCV 2b | 38 | 8 | 9 | A24 | VYPVIRASV | 5830 | 10.500 |
| 318 | HCV 2b | 38 | 2 | 10 | B_4403 | TESKsPVYPV | 5831 | 12.000 |
| 319 | HCV 2b | 39 | 18 | 9 | B7 | NIRCLPPLM | 5832 | 10.000 |
| 320 | HCV 2b | 39 | 16 | 10 | A_0201 | WQNIrCLPPL | 5833 | 22.915 |
| 321 | HCV 2b | 39 | 13 | 10 | A24 | FFEWqNIRCL | 5834 | 30.000 |
| 322 | HCV 2b | 39 | 22 | 10 | B_3501 | LPPLmEARGI | 5835 | 12.000 |
| 323 | HCV 2b | 40 | 1 | 9 | A_0201 | MLAWGVVTV | 5836 | 271.948 |
| 324 | HCV 2b | 40 | 34 | 9 | B7 | MPRMVVAST | 5837 | 20.000 |
| 325 | HCV 2b | 40 | 13 | 9 | B7 | VAVARTTSL | 5838 | 12.000 |

TABLE 4h-continued

2b (4-6)

| No. | Strain | ORF | Start | AA | HLA | Peptide sequence | SEQ ID NO: | Score |
|---|---|---|---|---|---|---|---|---|
| 326 | HCV 2b | 40 | 13 | 9 | B8 | VAVARTTSL | 5839 | 16.000 |
| 327 | HCV 2b | 40 | 6 | 10 | A_0201 | VVTVpGGVAV | 5840 | 10.346 |
| 328 | HCV 2b | 40 | 12 | 10 | B7 | GVAVaRTTSL | 5841 | 20.000 |
| 329 | HCV 2b | 40 | 28 | 10 | B7 | WSRTvPMPRM | 5842 | 15.000 |
| 330 | HCV 2b | 40 | 28 | 10 | B_3501 | WSRTvPMPRM | 5843 | 30.000 |
| 331 | HCV 2b | 40 | 40 | 10 | B_3501 | ASTEwHSSQM | 5844 | 20.000 |
| 332 | HCV 2b | 40 | 25 | 10 | B_3501 | VSAWsRTVPM | 5845 | 10.000 |
| 333 | HCV 2b | 41 | 1 | 9 | A_0201 | MLGLIPWAL | 5846 | 272.371 |
| 334 | HCV 2b | 42 | 9 | 9 | A24 | KSIDLATPL | 5847 | 17.280 |
| 335 | HCV 2b | 42 | 47 | 9 | A3 | GLGDSNAPR | 5848 | 12.000 |
| 336 | HCV 2b | 42 | 15 | 9 | B7 | TPLAHTAAL | 5849 | 80.000 |
| 337 | HCV 2b | 42 | 40 | 9 | B7 | DPLRVERGL | 5850 | 80.000 |
| 338 | HCV 2b | 42 | 52 | 9 | B7 | NAPRLSSFL | 5851 | 12.000 |
| 339 | HCV 2b | 42 | 9 | 9 | B_3501 | KSIDLATPL | 5852 | 20.000 |
| 340 | HCV 2b | 42 | 40 | 9 | B_3501 | DPLRVERGL | 5853 | 20.000 |
| 341 | HCV 2b | 42 | 15 | 9 | B_3501 | TPLAHTAAL | 5854 | 20.000 |
| 342 | HCV 2b | 42 | 36 | 9 | B_3501 | GPPDDPLRV | 5855 | 12.000 |
| 343 | HCV 2b | 42 | 56 | 9 | B_3501 | LSSFLRTGM | 5856 | 10.000 |
| 344 | HCV 2b | 42 | 51 | 9 | B_4403 | SNAPRLSSF | 5857 | 12.000 |
| 345 | HCV 2b | 42 | 47 | 10 | A_0201 | GLGDsNAPRL | 5858 | 87.586 |
| 346 | HCV 2b | 42 | 22 | 10 | A_0201 | ALNKpTACPL | 5859 | 21.362 |
| 347 | HCV 2b | 42 | 63 | 10 | A3 | GMTSaFRVTR | 5860 | 36.000 |
| 348 | HCV 2b | 42 | 53 | 10 | B7 | APRLsSFLRT | 5861 | 60.000 |
| 349 | HCV 2b | 42 | 22 | 10 | B7 | ALNKpTACPL | 5862 | 12.000 |
| 350 | HCV 2b | 42 | 14 | 10 | B7 | ATPLaHTAAL | 5863 | 12.000 |
| 351 | HCV 2b | 43 | 2 | 9 | B7 | APRRPRVC. | 5864 | 135.000 |
| 352 | HCV 2b | 44 | | | | no hits | | |
| 353 | HCV 2b | 45 | 12 | 9 | A_0201 | TMTFFSIGL | 5865 | 58.628 |
| 354 | HCV 2b | 45 | 28 | 9 | B8 | TARSRKPWA | 5866 | 16.000 |
| 355 | HCV 2b | 45 | 9 | 10 | B7 | APHTmTFFSI | 5867 | 24.000 |
| 356 | HCV 2b | 45 | 11 | 10 | B7 | HTMTfFSIGL | 5868 | 12.000 |
| 357 | HCV 2b | 45 | 28 | 10 | B8 | TARSrKPWAA | 5869 | 16.000 |
| 358 | HCV 2b | 46 | 2 | 9 | A_0201 | VINSIWIYL | 5870 | 46.689 |
| 359 | HCV 2b | 46 | 9 | 9 | A_0201 | YLAPARCLT | 5871 | 34.279 |
| 360 | HCV 2b | 46 | 5 | 9 | A_0201 | SIWIYLAPA | 5872 | 13.040 |
| 361 | HC2Vb | 46 | 7 | 9 | A_0201 | WIYLAPARC | 5873 | 10.055 |
| 362 | HCV 2b | 46 | 8 | 9 | A24 | IYLAPARCL | 5874 | 300.000 |
| 363 | HCV 2b | 46 | 11 | 9 | B7 | APARCLTRV | 5875 | 12.000 |
| 364 | HCV 2b | 46 | 1 | 10 | A_0201 | MVINsIWIYL | 5876 | 29.711 |
| 365 | HCV 2b | 46 | 9 | 10 | A3 | YLAPaRCLTR | 5877 | 12.000 |
| 366 | HCV 2b | 46 | 1 | 10 | B7 | MVINsIWIYL | 5878 | 20.000 |
| 367 | HCV 2b | 47 | | | | no hits | | |
| 368 | HCV 2b | 48 | | | | no hits | | |
| 369 | HCV 2b | 49 | 13 | 9 | A1 | LAECKMMSF | 5879 | 45.000 |
| 370 | HCV 2b | 49 | 17 | 9 | A_0201 | KMMSFSSAA | 5880 | 176.565 |
| 371 | HCV 2b | 49 | 40 | 9 | A3 | ILASASNRK | 5881 | 20.000 |
| 372 | HCV 2b | 49 | 9 | 9 | A3 | ALAALAECK | 5882 | 20.000 |
| 373 | HCV 2b | 49 | 31 | 10 | A_0201 | MMSIqRHAQI | 5883 | 12.809 |
| 374 | HCV 2b | 49 | 22 | 10 | B_3501 | SSAAsAWPSM | 5884 | 10.000 |
| 375 | HCV 2b | 49 | 14 | 10 | B_4403 | AECKmMSFSS | 5885 | 12.000 |
| 376 | HCV 2b | 50 | | | | no hits | | |
| 377 | HCV 2b | 51 | 30 | 9 | A_0201 | VLFSRKTSV | 5886 | 437.482 |
| 378 | HCV 2b | 51 | 9 | 9 | A_0201 | VLVNPVPFI | 5887 | 224.357 |
| 379 | HCV 2b | 51 | 32 | 9 | B7 | FSRKTSVSL | 5888 | 40.000 |
| 380 | HCV 2b | 51 | 23 | 9 | B7 | QAPRGGLVL | 5889 | 12.000 |
| 381 | HCV 2b | 51 | 6 | 9 | B7 | APHVLVNPV | 5890 | 12.000 |
| 382 | HCV 2b | 51 | 24 | 9 | B7 | APRGGLVLF | 5891 | 12.000 |
| 383 | HCV 2b | 51 | 24 | 9 | B_3501 | APRGGLVLF | 5892 | 60.000 |
| 384 | HCV 2b | 51 | 32 | 9 | B_3501 | FSRKTSVSL | 5893 | 15.000 |
| 385 | HCV 2b | 51 | 29 | 10 | A_0201 | LVLFsRKTSV | 5894 | 38.280 |
| 386 | HCV 2b | 51 | 10 | 10 | A_0201 | LVNPvPFIQV | 5895 | 19.657 |
| 387 | HCV 2b | 51 | 31 | 10 | A24 | LFSRkTSVSL | 5896 | 20.000 |
| 388 | HCV 2b | 51 | 20 | 10 | B7 | QPNQaPRGGL | 5897 | 180.000 |
| 389 | HCV 2b | 51 | 24 | 10 | B7 | APRGgLVLFS | 5898 | 12.000 |
| 390 | HCV 2b | 51 | 20 | 10 | B_3501 | QPNQaPRGGL | 5899 | 20.000 |
| 391 | HCV 2b | 52 | 32 | 9 | A_0201 | GQPELLNLL | 5900 | 20.425 |
| 392 | HCV 2b | 52 | 10 | 9 | A24 | SYSKVPHPI | 5901 | 70.000 |
| 393 | HCV 2b | 52 | 32 | 9 | A24 | GQPELLNLL | 5902 | 10.368 |
| 394 | HCV 2b | 52 | 3 | 9 | B_4403 | STLVTLVSY | 5903 | 18.000 |
| 395 | HCV 2b | 52 | 5 | 10 | A_0201 | LVTLvSYSKV | 5904 | 15.519 |
| 396 | HCV 2b | 52 | 31 | 10 | A24 | SGQPeLLNLL | 5905 | 10.368 |
| 397 | HCV 2b | 52 | 4 | 10 | A3 | TLVTlVSYSK | 5906 | 135.000 |
| 398 | HCV 2b | 52 | 30 | 10 | B_3501 | RSGQpELLNL | 5907 | 15.000 |
| 399 | HCV 2b | 52 | 2 | 10 | B_3501 | SSTLvTLVSY | 5908 | 10.000 |

TABLE 4h-continued

2b (4-6)

| No. | Strain | ORF | Start | AA | HLA | Peptide sequence | SEQ ID NO: | Score |
|---|---|---|---|---|---|---|---|---|
| 400 | HCV 2b | 53 | 40 | 9 | A_0201 | KLPTVRPTV | 5909 | 243.432 |
| 401 | HCV 2b | 53 | 6 | 9 | A_0201 | KLSLQLRAV | 5910 | 111.979 |
| 402 | HCV 2b | 53 | 16 | 9 | A_0201 | FMCQLPLVL | 5911 | 29.098 |
| 403 | HCV 2b | 53 | 22 | 9 | A_0201 | LVLINWTFC | 5912 | 25.565 |
| 404 | HCV 2b | 53 | 24 | 9 | A_0201 | LINWTFCWA | 5913 | 12.135 |
| 405 | HCV 2b | 53 | 12 | 9 | A24 | RAVRFMCQL | 5914 | 12.000 |
| 406 | HCV 2b | 53 | 12 | 9 | B7 | RAVRFMCQL | 5915 | 12.000 |
| 407 | HCV 2b | 53 | 43 | 9 | B7 | TVRPTVAPV | 5916 | 10.000 |
| 408 | HCV 2b | 53 | 19 | 10 | A_0201 | QLPLvLINWT | 5917 | 94.268 |
| 409 | HCV 2b | 53 | 23 | 10 | A_0201 | VLINwTFCWA | 5918 | 88.257 |
| 410 | HCV 2b | 53 | 16 | 10 | A_0201 | FMCQlPLVLI | 5919 | 79.718 |
| 411 | HCV 2b | 53 | 9 | 10 | A_0201 | LQLRaVRFMC | 5920 | 18.376 |
| 412 | HCV 2b | 53 | 8 | 10 | A_0201 | SLQLrAVRFM | 5921 | 12.569 |
| 413 | HCV 2b | 53 | 15 | 10 | A24 | RFMCqLPLVL | 5922 | 72.000 |
| 414 | HCV 2b | 53 | 2 | 10 | A24 | KPVCkLSLQL | 5923 | 14.400 |
| 415 | HCV 2b | 53 | 6 | 10 | A3 | KLSLqLRAVR | 5924 | 12.000 |
| 416 | HCV 2b | 53 | 13 | 10 | B7 | AVRFmCQLPL | 5925 | 600.000 |
| 417 | HCV 2b | 53 | 32 | 10 | B7 | APSLkRPAKL | 5926 | 240.000 |
| 418 | HCV 2b | 53 | 2 | 10 | B7 | KPVCkLSLQL | 5927 | 80.000 |
| 419 | HCV 2b | 53 | 32 | 10 | B8 | APSLkRPAKL | 5928 | 16.000 |
| 420 | HCV 2b | 53 | 2 | 10 | B_3501 | KPVCkLSLQL | 5929 | 40.000 |
| 421 | HCV 2b | 53 | 32 | 10 | B_3501 | APSLkRPAKL | 5930 | 20.000 |
| 422 | HCV 2b | 53 | 20 | 10 | B_3501 | LPLVlINWTF | 5931 | 20.000 |
| 423 | HCV 2b | 54 | 4 | 10 | A3 | TLAHaPCMEK | 5932 | 60.000 |
| 424 | HCV 2b | 55 | 10 | 10 | A_0201 | IMSHaMRWPV | 5933 | 640.458 |
| 425 | HCV 2b | 55 | 1 | 10 | B7 | MVRVgDQFSI | 5934 | 20.000 |
| 426 | HCV 2b | 56 | 9 | 9 | A_0201 | KLWRSGDTI | 5935 | 148.506 |
| 427 | HCV 2b | 56 | 35 | 9 | B_4403 | AEQTVAAIT | 5936 | 18.000 |
| 428 | HCV 2b | 56 | 24 | 10 | A1 | ITAPhTSPTY | 5937 | 25.000 |
| 429 | HCV 2b | 56 | 9 | 10 | A3 | KLWRsGDTIR | 5938 | 60.000 |
| 430 | HCV 2b | 56 | 3 | 10 | A3 | QLHSwVKLWR | 5939 | 12.000 |
| 431 | HCV 2b | 56 | 35 | 10 | B_4403 | AEQTvAAITI | 5940 | 18.000 |
| 432 | HCV 2b | 56 | 24 | 10 | B_4403 | ITAPhTSPTY | 5941 | 12.000 |
| 432 | HCV 2b | 56 | 24 | 10 | B_4403 | ITAPhTSPTY | 5942 | 12.000 |
| 433 | HCV 2b | 57 | 1 | 9 | A_0201 | MLLFEQSLV | 5943 | 437.482 |
| 434 | HCV 2b | 57 | 2 | 9 | A_0201 | LLFEQSLVA | 5944 | 52.529 |
| 435 | HCV 2b | 58 | 24 | 9 | A_0201 | KEQPGKFLV | 5945 | 27.454 |
| 436 | HCV 2b | 58 | 22 | 9 | B_4403 | IEKEQPGKF | 5946 | 60.000 |
| 437 | HCV 2b | 58 | 24 | 9 | B_4403 | KEQPGKFLV | 5947 | 12.000 |
| 438 | HCV 2b | 58 | 2 | 10 | A_0201 | FLIStEDTGT | 5948 | 34.279 |
| 439 | HCV 2b | 58 | 24 | 10 | B_4403 | KEQPgKFLVA | 5949 | 12.000 |
| 440 | HCV 2b | 59 | 83 | 9 | A1 | RSEVFLVAR | 5950 | 27.000 |
| 441 | HCV 2b | 59 | 87 | 9 | A_0201 | FLVARTPNL | 5951 | 98.267 |
| 442 | HCV 2b | 59 | 56 | 9 | A24 | GYPGFPQDL | 5952 | 360.000 |
| 443 | HCV 2b | 59 | 11 | 9 | A3 | VMVSMTLPK | 5953 | 60.000 |
| 444 | HCV 2b | 59 | 12 | 9 | B7 | MVSMTLPKL | 5954 | 20.000 |
| 445 | HCV 2b | 59 | 42 | 9 | B_3501 | QPAQPQPSF | 5955 | 20.000 |
| 446 | HCV 2b | 59 | 69 | 9 | B_3501 | RSFGMGWRL | 5956 | 10.000 |
| 447 | HCV 2b | 59 | 84 | 9 | B_4403 | SEVFLVART | 5957 | 48.000 |
| 448 | HCV 2b | 59 | 11 | 10 | A_0201 | VMVSmTLPKL | 5958 | 60.325 |
| 449 | HCV 2b | 59 | 79 | 10 | A_0201 | RGWDrSEVFL | 5959 | 26.100 |
| 450 | HCV 2b | 59 | 86 | 10 | A24 | VFLVaRTPNL | 5960 | 30.000 |
| 451 | HCV 2b | 59 | 8 | 10 | A24 | KPHVmVSMTL | 5961 | 11.200 |
| 452 | HCV 2b | 59 | 51 | 10 | A24 | PYRGqGYPGF | 5962 | 10.000 |
| 453 | HCV 2b | 59 | 89 | 10 | B7 | VARTpNLGPL | 5963 | 120.000 |
| 454 | HCV 2b | 59 | 8 | 10 | B7 | KPHVmVSMTL | 5964 | 80.000 |
| 455 | HCV 2b | 59 | 19 | 10 | B7 | KLRDlCRGSL | 5965 | 60.000 |
| 456 | HCV 2b | 59 | 77 | 10 | B7 | LPRGwDRSEV | 5966 | 60.000 |
| 457 | HCV 2b | 59 | 35 | 10 | B7 | DPRGdRSQPA | 5967 | 20.000 |
| 458 | HCV 2b | 59 | 64 | 10 | B7 | LPVErRSFGM | 5968 | 20.000 |
| 459 | HCV 2b | 59 | 2 | 10 | B7 | YPMRsAKPHV | 5969 | 12.000 |
| 460 | HCV 2b | 59 | 35 | 10 | B8 | DPRGdRSQPA | 5970 | 32.000 |
| 461 | HCV 2b | 59 | 89 | 10 | B8 | VARTpNLGPL | 5971 | 16.000 |
| 462 | HCV 2b | 59 | 64 | 10 | B_3501 | LPVErRSFGM | 5972 | 80.000 |
| 463 | HCV 2b | 59 | 8 | 10 | B_3501 | KPHVmVSMTL | 5973 | 40.000 |
| 464 | HCV 2b | 59 | 77 | 10 | B_3501 | LPRGwDRSEV | 5974 | 18.000 |
| 465 | HCV 2b | 59 | 6 | 10 | B_3501 | SAKPhVMVSM | 5975 | 18.000 |
| 466 | HCV 2b | 59 | 19 | 10 | B_3501 | KLRDlCRGSL | 5976 | 12.000 |
| 467 | HCV 2b | 59 | 62 | 10 | B_4403 | QDLPvERRSF | 5977 | 20.000 |
| 468 | HCV 2b | 59 | 66 | 10 | B_4403 | VERRsFGMGW | 5978 | 12.000 |
| 469 | HCV 2b | 60 | | | | no hits | | |
| 470 | HCV 2b | 61 | 7 | 9 | A_0201 | VLPHGPDVV | 5979 | 23.754 |
| 471 | HCV 2b | 62 | 15 | 9 | A_0201 | LLLLGPTWC | 5980 | 171.868 |
| 472 | HCV 2b | 62 | 16 | 9 | A3 | LLLGPTWCY | 5981 | 40.500 |

TABLE 4h-continued

2b (4-6)

| No. | Strain | ORF | Start | AA | HLA | Peptide sequence | SEQ ID NO: | Score |
|---|---|---|---|---|---|---|---|---|
| 473 | HCV 2b | 62 | 8 | 9 | B7 | TQRADWQLL | 5982 | 40.000 |
| 474 | HCV 2b | 62 | 14 | 10 | A_0201 | QLLLlGPTWC | 5983 | 101.099 |
| 475 | HCV 2b | 62 | 22 | 10 | A_0201 | WCYEgSCPGV | 5984 | 27.401 |
| 476 | HCV 2b | 62 | 6 | 10 | A_0201 | RVTQrADWQL | 5985 | 14.019 |
| 477 | HCV 2b | 62 | 15 | 10 | A3 | LLLLgPTWCY | 5986 | 27.000 |
| 478 | HCV 2b | 62 | 8 | 10 | B7 | TQRAdWQLLL | 5987 | 40.000 |
| 479 | HCV 2b | 62 | 6 | 10 | B7 | RVTQrADWQL | 5988 | 20.000 |
| 480 | HCV 2b | 63 | | | | no hits | | |
| 481 | HCV 2b | 64 | | | | no hits | | |
| 482 | HCV 2b | 65 | 13 | 9 | B7 | HPLDRPLSL | 5989 | 80.000 |
| 483 | HCV 2b | 65 | 11 | 9 | B7 | SVHPLDRPL | 5990 | 20.000 |
| 484 | HCV 2b | 65 | 13 | 9 | B8 | HPLDRPLSL | 5991 | 24.000 |
| 485 | HCV 2b | 65 | 13 | 9 | B_3501 | HPLDRPLSL | 5992 | 40.000 |
| 486 | HCV 2b | 65 | 20 | 10 | A_0201 | SLADvAAQDC | 5993 | 20.369 |
| 487 | HCV 2b | 65 | 3 | 10 | B7 | SPRGkGDQSV | 5994 | 40.000 |
| 488 | HCV 2b | 65 | 3 | 10 | B_3501 | SPRGkGDQSV | 5995 | 12.000 |
| 489 | HCV 2b | 65 | 27 | 10 | B_4403 | QDCCaNDSHY | 5996 | 15.000 |
| 490 | HCV 2b | 66 | 6 | 9 | A_0201 | LVGHGTQAV | 5997 | 10.346 |
| 491 | HCV 2b | 66 | 5 | 10 | A_0201 | NLVGhGTQAV | 5998 | 69.552 |
| 492 | HCV 2b | 67 | | | | no hits | | |
| 493 | HCV 2b | 68 | | | | no hits | | |
| 494 | HCV 2b | 69 | 9 | 9 | A_0201 | CLSPPHDDL | 5999 | 10.468 |
| 495 | HCV 2b | 69 | 11 | 9 | B7 | SPPHDDLLL | 6000 | 80.000 |
| 496 | HCV 2b | 69 | 29 | 9 | B7 | GNRQVPQTL | 6001 | 40.000 |
| 497 | HCV 2b | 69 | 11 | 9 | B_3501 | SPPHDDLLL | 6002 | 30.000 |
| 498 | HCV 2b | 69 | 18 | 10 | A_0201 | LLHWaEHDRL | 6003 | 17.795 |
| 499 | HCV 2b | 69 | 9 | 10 | A_0201 | CLSPpHDDLL | 6004 | 10.468 |
| 500 | HCV 2b | 69 | 28 | 10 | A24 | HGNRqVPQTL | 6005 | 10.080 |
| 501 | HCV 2b | 70 | | | | no hits | | |
| 502 | HCV 2b | 71 | 42 | 9 | A_0201 | TLNIGSIWV | 6006 | 382.536 |
| 503 | HCV 2b | 71 | 20 | 9 | A_0201 | WIMPQSVRV | 6007 | 162.769 |
| 504 | HCV 2b | 71 | 47 | 9 | A_0201 | SIWVLPKTV | 6008 | 79.376 |
| 505 | HCV 2b | 71 | 50 | 9 | A_0201 | VLPKTVCRA | 6009 | 19.425 |
| 506 | HCV 2b | 71 | 21 | 9 | A_0201 | IMPQSVRVV | 6010 | 16.105 |
| 507 | HCV 2b | 71 | 3 | 9 | B7 | HPPYIHPHL | 6011 | 80.000 |
| 508 | HCV 2b | 71 | 22 | 9 | B_3501 | MPQSVRVVY | 6012 | 40.000 |
| 509 | HCV 2b | 71 | 3 | 9 | B_3501 | HPPYIHPHL | 6013 | 20.000 |
| 510 | HCV 2b | 71 | 8 | 9 | B_3501 | HPHLEDGEI | 6014 | 12.000 |
| 511 | HCV 2b | 71 | 14 | 9 | B_4403 | GEIYGAWIM | 6015 | 30.000 |
| 512 | HCV 2b | 71 | 42 | 10 | A_0201 | TLNIgSIWVL | 6016 | 151.086 |
| 513 | HCV 2b | 71 | 20 | 10 | A_0201 | WIMPqSVRVV | 6017 | 30.698 |
| 514 | HCV 2b | 71 | 41 | 10 | A_0201 | STLNigSIWV | 6018 | 19.658 |
| 515 | HCV 2b | 71 | 49 | 10 | A_0201 | WVLPkTVCRA | 6019 | 17.017 |
| 516 | HCV 2b | 71 | 44 | 10 | A3 | NIGSiWVLPK | 6020 | 36.000 |
| 517 | HCV 2b | 71 | 8 | 10 | B_3501 | HPHLeDGEIY | 6021 | 60.000 |
| 518 | HCV 2b | 71 | 11 | 10 | B_4403 | LEDGeIYGAW | 6022 | 18.000 |
| 519 | HCV 2b | 72 | 49 | 9 | A_0201 | KQGGHETRV | 6023 | 24.681 |
| 520 | HCV 2b | 72 | 68 | 9 | A24 | VYVPAAVGI | 6024 | 90.000 |
| 521 | HCV 2b | 72 | 8 | 9 | A24 | VFNIGDVGL | 6025 | 30.000 |
| 522 | HCV 2b | 72 | 29 | 9 | B7 | QPTAGRQTL | 6026 | 120.000 |
| 523 | HCV 2b | 72 | 3 | 9 | B7 | AVRPHVFNI | 6027 | 60.000 |
| 524 | HCV 2b | 72 | 1 | 9 | B_3501 | MPAVRPHVF | 6028 | 20.000 |
| 525 | HCV 2b | 72 | 29 | 9 | B_3501 | QPTAGRQTL | 6029 | 20.000 |
| 526 | HCV 2b | 72 | 61 | 9 | B_3501 | IAVEGGPVY | 6030 | 12.000 |
| 527 | HCV 2b | 72 | 61 | 10 | A_0201 | IAVEgGPVYV | 6031 | 37.032 |
| 528 | HCV 2b | 72 | 39 | 10 | B7 | AARAvEFVGI | 6032 | 36.000 |
| 529 | HCV 2b | 72 | 7 | 10 | B7 | HVFNiGDVGL | 6033 | 20.000 |
| 530 | HCV 2b | 72 | 9 | 10 | B_4403 | FNIGdVGLVF | 6034 | 11.250 |
| 531 | HCV 2b | 73 | 2 | 10 | B7 | AAEDnFQDQL | 6035 | 10.800 |
| 532 | HCV 2b | 74 | 57 | 9 | A1 | VSECTAVFY | 6036 | 135.000 |
| 533 | HCV 2b | 74 | 71 | 9 | A_0201 | YLYPAAQGT | 6037 | 109.693 |
| 534 | HCV 2b | 74 | 2 | 9 | A_0201 | TLVDGTVAL | 6038 | 87.586 |
| 535 | HCV 2b | 74 | 64 | 9 | A24 | FYSHIRCYL | 6039 | 280.000 |
| 536 | HCV 2b | 74 | 72 | 9 | A24 | LYPAAQGTI | 6040 | 75.000 |
| 537 | HCV 2b | 74 | 16 | 9 | A24 | AFWRYYKSL | 6041 | 20.000 |
| 538 | HCV 2b | 74 | 90 | 9 | A24 | KMENCVSEL | 6042 | 13.200 |
| 539 | HCV 2b | 74 | 82 | 9 | A3 | ILAWDTSRK | 6043 | 20.000 |
| 540 | HCV 2b | 74 | 14 | 9 | A3 | VVAFWRYYK | 6044 | 18.000 |
| 541 | HCV 2b | 74 | 9 | 9 | A3 | ALLGKVVAF | 6045 | 13.500 |
| 542 | HCV 2b | 74 | 75 | 9 | B7 | AAQGTIVIL | 6046 | 36.000 |
| 543 | HCV 2b | 74 | 103 | 9 | B7 | VVRAIISGV | 6047 | 10.000 |
| 544 | HCV 2b | 74 | 83 | 9 | B_3501 | LAWDTSRKM | 6048 | 12.000 |
| 545 | HCV 2b | 74 | 65 | 9 | B_3501 | YSHIRCYLY | 6049 | 10.000 |
| 546 | HCV 2b | 74 | 58 | 9 | B_4403 | SECTAVFYS | 6050 | 54.000 |

TABLE 4h-continued

2b (4-6)

| No. | Strain | ORF | Start | AA | HLA | Peptide sequence | SEQ ID NO: | Score |
|---|---|---|---|---|---|---|---|---|
| 547 | HCV 2b | 74 | 96 | 9 | B_4403 | SELPGDAVV | 6051 | 32.000 |
| 548 | HCV 2b | 74 | 2 | 10 | A_0201 | TLVDgTVALL | 6052 | 201.447 |
| 549 | HCV 2b | 74 | 71 | 10 | A_0201 | YLYPaAQGTI | 6053 | 19.964 |
| 550 | HCV 2b | 74 | 102 | 10 | A_0201 | AVVRaIISGV | 6054 | 13.997 |
| 551 | HCV 2b | 74 | 94 | 10 | A_0201 | CVSElPGDAV | 6055 | 12.226 |
| 552 | HCV 2b | 74 | 63 | 10 | A24 | VFYShIRCYL | 6056 | 28.000 |
| 553 | HCV 2b | 74 | 13 | 10 | A3 | KVVAfWRYYK | 6057 | 81.000 |
| 554 | HCV 2b | 74 | 10 | 10 | A3 | LLGKvVAFWR | 6058 | 18.000 |
| 555 | HCV 2b | 74 | 15 | 10 | B7 | VAFWrYYKSL | 6059 | 12.000 |
| 556 | HCV 2b | 74 | 103 | 10 | B7 | VVRAiISGVV | 6060 | 10.000 |
| 557 | HCV 2b | 74 | 38 | 10 | B_3501 | QSRAdRSCHY | 6061 | 30.000 |
| 558 | HCV 2b | 74 | 98 | 10 | B_3501 | LPGDaVVRAI | 6062 | 16.000 |
| 559 | HCV 2b | 75 | 90 | 9 | A_0201 | RELDVLWAA | 6063 | 25.279 |
| 560 | HCV 2b | 75 | 18 | 9 | B7 | EPTCPTATL | 6064 | 120.000 |
| 561 | HCV 2b | 75 | 29 | 9 | B7 | IQRPRISWL | 6065 | 40.000 |
| 562 | HCV 2b | 75 | 139 | 9 | B7 | TQRYSASSL | 6066 | 40.000 |
| 563 | HCV 2b | 75 | 87 | 9 | B7 | AATRELDVL | 6067 | 36.000 |
| 564 | HCV 2b | 75 | 44 | 9 | B7 | GAPIFRDGL | 6068 | 18.000 |
| 565 | HCV 2b | 75 | 53 | 9 | B7 | ASPTRLGSL | 6069 | 12.000 |
| 566 | HCV 2b | 75 | 29 | 9 | B8 | IQRPRISWL | 6070 | 24.000 |
| 567 | HCV 2b | 75 | 18 | 9 | B_3501 | EPTCPTATL | 6071 | 20.000 |
| 568 | HCV 2b | 75 | 117 | 9 | B_3501 | RSTRPPGAL | 6072 | 10.000 |
| 569 | HCV 2b | 75 | 90 | 9 | B_4403 | RELDVLWAA | 6073 | 18.000 |
| 570 | HCV 2b | 75 | 98 | 10 | A_0201 | AVCVsFGFSL | 6074 | 41.197 |
| 571 | HCV 2b | 75 | 28 | 10 | A_0201 | SIQRpRISWL | 6075 | 37.157 |
| 572 | HCV 2b | 75 | 90 | 10 | A_0201 | RELDvLWAAV | 6076 | 34.877 |
| 573 | HCV 2b | 75 | 25 | 10 | A_0201 | TLVSiQRPRI | 6077 | 10.433 |
| 574 | HCV 2b | 75 | 77 | 10 | A24 | RQQVnSANDL | 6078 | 14.400 |
| 575 | HCV 2b | 75 | 120 | 10 | A24 | RPPGaLASTL | 6079 | 14.400 |
| 576 | HCV 2b | 75 | 141 | 10 | A24 | RYSAsSLAGA | 6080 | 10.000 |
| 577 | HCV 2b | 75 | 40 | 10 | A3 | GLAGgAPIFR | 6081 | 36.000 |
| 578 | HCV 2b | 75 | 94 | 10 | A3 | VLWAaVCVSF | 6082 | 15.000 |
| 579 | HCV 2b | 75 | 52 | 10 | B8 | LASPStRLGSL | 6083 | 16.000 |
| 580 | HCV 2b | 75 | 115 | 10 | B8 | GARStRPPGA | 6084 | 16.000 |
| 581 | HCV 2b | 75 | 120 | 10 | B_3501 | RPPGaLASTL | 6085 | 40.000 |
| 582 | HCV 2b | 75 | 133 | 10 | B_4403 | TTRPfATQRY | 6086 | 13.500 |

TABLE 4i

3a (1-3)

| No. | Strain | ORF | Start | AA | HLA | Peptide sequence | SEQ ID NO: | Score |
|---|---|---|---|---|---|---|---|---|
| 1 | HCV 3a | 1 | 2 | 9 | A_0201 | ALVRVSCSL | 6087 | 21.362 |
| 2 | HCV 3a | 1 | 2 | 9 | B7 | ALVRVSCSL | 6088 | 12.000 |
| 3 | HCV 3a | 1 | 1 | 10 | B7 | MALVRVSCSL | 6089 | 12.000 |
| 4 | HCV 3a | 2 | 32 | 10 | A_0201 | AIWVKSSIPL | 6090 | 24.380 |
| 5 | HCV 3a | 2 | 13 | 9 | B7 | CPRAAPVHL | 6091 | 800.000 |
| 6 | HCV 3a | 2 | 17 | 9 | B7 | APVHLGAQM | 6092 | 60.000 |
| 7 | HCV 3a | 2 | 32 | 10 | B7 | AIWVKSSIPL | 6093 | 12.000 |
| 8 | HCV 3a | 2 | 13 | 9 | B8 | CPRAAPVHL | 6094 | 16.000 |
| 9 | HCV 3a | 2 | 13 | 9 | B_3501 | CPRAAPVHL | 6095 | 60.000 |
| 10 | HCV 3a | 2 | 17 | 9 | B_3501 | APVHLGAQM | 6096 | 40.000 |
| 11 | HCV 3a | 2 | 26 | 9 | B_3501 | TPGGGPAIW | 6097 | 10.000 |
| 12 | HCV 3a | 3 | 8 | 10 | A1 | CTHPAAYLVF | 6098 | 12.500 |
| 13 | HCV 3a | 3 | 13 | 9 | A24 | AYLVFRTTI | 6099 | 75.000 |
| 14 | HCV 3a | 3 | 6 | 10 | A24 | SFCTHPAAYL | 6100 | 20.000 |
| 15 | HCV 3a | 3 | 5 | 10 | B_3501 | TSFCtHPAAY | 6101 | 10.000 |
| 16 | HCV 3a | 4 | 1 | 10 | A_0201 | MPPEgLLAFL | 6102 | 12.295 |
| 17 | HCV 3a | 4 | 13 | 9 | B7 | APNRNCSWL | 6103 | 240.000 |
| 18 | HCV 3a | 4 | 24 | 9 | B7 | MARGTSTAL | 6104 | 120.000 |
| 19 | HCV 3a | 4 | 1 | 10 | B7 | MPPEgLLAFL | 6105 | 80.000 |
| 20 | HCV 3a | 4 | 12 | 10 | B7 | WAPNrNCSWL | 6106 | 12.000 |
| 21 | HCV 3a | 4 | 24 | 9 | B8 | MARGTSTAL | 6107 | 16.000 |
| 22 | HCV 3a | 4 | 1 | 9 | B_3501 | MPPEGLLAF | 6108 | 40.000 |
| 23 | HCV 3a | 4 | 13 | 9 | B_3501 | APNRNCSWL | 6109 | 20.000 |
| 24 | HCV 3a | 4 | 1 | 10 | B_3501 | MPPEgLLAFL | 6110 | 40.000 |
| 25 | HCV 3a | 5 | 5 | 9 | A_0201 | GLLAFLVWA | 6111 | 883.604 |
| 26 | HCV 3a | 5 | 1 | 10 | A_0201 | MPPEgLLAFL | 6112 | 12.295 |
| 27 | HCV 3a | 5 | 32 | 9 | A3 | VLYTASHHR | 6113 | 20.000 |
| 28 | HCV 3a | 5 | 18 | 9 | A3 | HLDLVKLSR | 6114 | 12.000 |

TABLE 4i-continued

3a (1-3)

| No. | Strain | ORF | Start | AA | HLA | Peptide sequence | SEQ ID NO: | Score |
|---|---|---|---|---|---|---|---|---|
| 29 | HCV | 3a | 5 | 13 | 9 B7 | TAGTTHLDL | 6115 | 12.000 |
| 30 | HCV | 3a | 5 | 24 | 10 B7 | LSRHqVSAVL | 6116 | 40.000 |
| 31 | HCV | 3a | 5 | 10 | 10 B7 | TNRTaGTTHL | 6117 | 40.000 |
| 32 | HCV | 3a | 5 | 24 | 10 B_3501 | LSRHqVSAVL | 6118 | 15.000 |
| 33 | HCV | 3a | 6 | 23 | 9 A24 | CGLPVVGGL | 6119 | 10.080 |
| 34 | HCV | 3a | 6 | 8 | 9 B7 | TPGVRMIPM | 6120 | 20.000 |
| 35 | HCV | 3a | 6 | 8 | 9 B_3501 | TPGVRMIPM | 6121 | 40.000 |
| 36 | HCV | 3a | 7 | 22 | 10 A_0201 | NILRpHTAGV | 6122 | 35.385 |
| 37 | HCV | 3a | 7 | 15 | 9 B7 | APPTASGNI | 6123 | 24.000 |
| 38 | HCV | 3a | 7 | 15 | 10 B7 | APPTaSGNIL | 6124 | 240.000 |
| 39 | HCV | 3a | 7 | 15 | 10 B_3501 | APPTaSGNIL | 6125 | 20.000 |
| 40 | HCV | 3a | 8 | 7 | 10 A3 | ALDLaWWDGR | 6126 | 12.000 |
| 41 | HCV | 3a | 8 | 43 | 9 A1 | YVDASPPSK | 6127 | 20.000 |
| 42 | HCV | 3a | 9 | 57 | 9 A_0201 | YLHAGVGTV | 6128 | 95.662 |
| 43 | HCV | 3a | 9 | 36 | 9 A_0201 | YGGTSTPYV | 6129 | 11.487 |
| 44 | HCV | 3a | 9 | 21 | 10 A_0201 | SLPYhPGTSI | 6130 | 10.433 |
| 45 | HCV | 3a | 9 | 34 | 10 A3 | ALYGgTSTPY | 6131 | 30.000 |
| 46 | HCV | 3a | 9 | 2 | 9 B7 | RGRVKTALL | 6132 | 40.000 |
| 47 | HCV | 3a | 9 | 22 | 9 B7 | LPYHPGTSI | 6133 | 12.000 |
| 48 | HCV | 3a | 9 | 4 | 10 B7 | RVKTaLLSAL | 6134 | 20.000 |
| 49 | HCV | 3a | 9 | 16 | 9 B_3501 | WPSSASLPY | 6135 | 40.000 |
| 50 | HCV | 3a | 9 | 28 | 9 B_3501 | TSIGSAALY | 6136 | 10.000 |
| 51 | HCV | 3a | 9 | 28 | 9 B_4403 | TSIGSAALY | 6137 | 33.750 |
| 52 | HCV | 3a | 10 | 20 | 9 A_0201 | KLGAFLGLL | 6138 | 84.952 |
| 53 | HCV | 3a | 10 | 13 | 9 A24 | RSQHTPSKL | 6139 | 13.200 |
| 54 | HCV | 3a | 10 | 17 | 9 B7 | TPSKLGAFL | 6140 | 80.000 |
| 55 | HCV | 3a | 10 | 17 | 9 B_3501 | TPSKLGAFL | 6141 | 20.000 |
| 56 | HCV | 3a | 10 | 13 | 9 B_3501 | RSQHTPSKL | 6142 | 10.000 |
| 57 | HCV | 3a | 11 | 13 | 9 B7 | IPRSKCTQM | 6143 | 200.000 |
| 58 | HCV | 3a | 11 | 10 | 9 B7 | APNIPRSKC | 6144 | 13.500 |
| 59 | HCV | 3a | 11 | 13 | 9 B8 | IPRSKCTQM | 6145 | 80.000 |
| 60 | HCV | 3a | 11 | 13 | 9 B_3501 | IPRSKCTQM | 6146 | 120.000 |
| 61 | HCV | 3a | 12 | 19 | 9 A1 | VLDLSPVSK | 6147 | 20.000 |
| 62 | HCV | 3a | 12 | 38 | 10 A24 | RGMLqGSLGL | 6148 | 12.000 |
| 63 | HCV | 3a | 12 | 19 | 9 A3 | VLDLSPVSK | 6149 | 20.000 |
| 64 | HCV | 3a | 12 | 12 | 9 B7 | TPQRACSVL | 6150 | 80.000 |
| 65 | HCV | 3a | 12 | 36 | 10 B7 | ALRGmLQGSL | 6151 | 120.000 |
| 66 | HCV | 3a | 12 | 28 | 10 B7 | VPLEvLLCAL | 6152 | 80.000 |
| 67 | HCV | 3a | 12 | 38 | 10 B7 | RGMLqGSLGL | 6153 | 12.000 |
| 68 | HCV | 3a | 12 | 12 | 9 B_3501 | TPQRACSVL | 6154 | 20.000 |
| 69 | HCV | 3a | 12 | 25 | 9 B_3501 | VSKVPLEVL | 6155 | 15.000 |
| 70 | HCV | 3a | 12 | 28 | 10 B_3501 | VPLEvLLCAL | 6156 | 40.000 |
| 71 | HCV | 3a | 12 | 25 | 10 B_3501 | VSKVpLEVLL | 6157 | 15.000 |
| 72 | HCV | 3a | 13 | 13 | 10 A24 | RPLTwHKDIL | 6158 | 12.000 |
| 73 | HCV | 3a | 13 | 1 | 9 B7 | MPRPAAVKA | 6159 | 20.000 |
| 74 | HCV | 3a | 13 | 13 | 10 B7 | RPLTwHKDIL | 6160 | 80.000 |
| 75 | HCV | 3a | 13 | 6 | 10 B7 | AVKAqRSRPL | 6161 | 60.000 |
| 76 | HCV | 3a | 13 | 6 | 10 B8 | AVKAqRSRPL | 6162 | 80.000 |
| 77 | HCV | 3a | 13 | 13 | 9 B_3501 | RPLTWHKDI | 6163 | 16.000 |
| 78 | HCV | 3a | 13 | 13 | 10 B_3501 | RPLTwHKDIL | 6164 | 40.000 |
| 79 | HCV | 3a | 14 | 8 | 9 A_0201 | ALGTAPLQL | 6165 | 21.362 |
| 80 | HCV | 3a | 14 | 8 | 10 A_0201 | ALGTaPLQLV | 6166 | 159.970 |
| 81 | HCV | 3a | 14 | 8 | 9 B7 | ALGTAPLQL | 6167 | 12.000 |
| 82 | HCV | 3a | 14 | 7 | 9 B7 | SALGtAPLQL | 6168 | 12.000 |
| 83 | HCV | 3a | 15 | 2 | 10 A1 | NVMPkTLLAY | 6169 | 25.000 |
| 84 | HCV | 3a | 15 | 7 | 9 A_0201 | TLLAYWVSA | 6170 | 31.249 |
| 85 | HCV | 3a | 15 | 8 | 9 A3 | LLAYWVSAR | 6171 | 36.000 |
| 86 | HCV | 3a | 15 | 3 | 9 A3 | VMPKTLLAY | 6172 | 12.000 |
| 87 | HCV | 3a | 15 | 7 | 10 A3 | TLLAyWVSAR | 6173 | 54.000 |
| 88 | HCV | 3a | 15 | 4 | 9 B_3501 | MPKTLLAYW | 6174 | 30.000 |
| 89 | HCV | 3a | 15 | 4 | 10 B_3501 | MPKTlLAYWV | 6175 | 12.000 |
| 90 | HCV | 3a | 17 | 19 | 9 A1 | HTDMSPPVK | 6176 | 50.000 |
| 91 | HCV | 3a | 17 | 35 | 9 A_0201 | RLFSVSAMT | 6177 | 27.572 |
| 92 | HCV | 3a | 17 | 22 | 9 A24 | MSPPVKDRL | 6178 | 10.080 |
| 93 | HCV | 3a | 17 | 30 | 10 A_0201 | LECLtRLFSV | 6179 | 30.670 |
| 94 | HCV | 3a | 17 | 32 | 10 A_0201 | CLTRlFSVSA | 6180 | 18.878 |
| 95 | HCV | 3a | 17 | 35 | 10 A3 | RLFSvSAMTR | 6181 | 40.000 |
| 96 | HCV | 3a | 17 | 10 | 9 B7 | AVRAEVDSV | 6182 | 30.000 |
| 97 | HCV | 3a | 17 | 45 | 10 B7 | AARGtISSPL | 6183 | 360.000 |
| 98 | HCV | 3a | 17 | 33 | 10 B7 | LTRLfSVSAM | 6184 | 10.000 |
| 99 | HCV | 3a | 17 | 25 | 9 B8 | PVKDRLECL | 6185 | 12.000 |
| 100 | HCV | 3a | 17 | 45 | 10 B8 | AARGtISSPL | 6186 | 16.000 |
| 101 | HCV | 3a | 17 | 13 | 10 B_4403 | AEVDsVHTDM | 6187 | 36.000 |
| 102 | HCV | 3a | 19 | 4 | 9 A24 | RPFYIGWGL | 6188 | 11.200 |
| 103 | HCV | 3a | 19 | 6 | 10 A24 | FYIGwGLSKM | 6189 | 41.250 |

TABLE 4i-continued

3a (1-3)

| No. | Strain | ORF | Start | AA | HLA | Peptide sequence | SEQ ID NO: | Score |
|---|---|---|---|---|---|---|---|---|
| 104 | HCV | 3a | 19 | 4 | 9 B7 | RPFYIGWGL | 6190 | 80.000 |
| 105 | HCV | 3a | 19 | 4 | 9 B_3501 | RPFYIGWGL | 6191 | 40.000 |
| 106 | HCV | 3a | 20 | 8 | 9 A24 | KPPRTSSKL | 6192 | 13.200 |
| 107 | HCV | 3a | 20 | 8 | 9 B7 | KPPRTSSKL | 6193 | 80.000 |
| 108 | HCV | 3a | 20 | 8 | 9 B_3501 | KPPRTSSKL | 6194 | 40.000 |
| 109 | HCV | 3a | 21 | 3 | 9 A_0201 | LVSQAPWWL | 6195 | 131.078 |
| 110 | HCV | 3a | 21 | 33 | 9 A_0201 | YLRVLSSSV | 6196 | 24.315 |
| 111 | HCV | 3a | 21 | 2 | 10 A_0201 | ELVSqAPWWL | 6197 | 66.090 |
| 112 | HCV | 3a | 21 | 3 | 10 A_0201 | LVSQaPWWLL | 6198 | 40.515 |
| 113 | HCV | 3a | 21 | 32 | 9 A24 | YYLRVLSSS | 6199 | 10.500 |
| 114 | HCV | 3a | 21 | 29 | 9 B7 | CPPYYLRVL | 6200 | 80.000 |
| 115 | HCV | 3a | 21 | 3 | 9 B7 | LVSQAPWWL | 6201 | 20.000 |
| 116 | HCV | 3a | 21 | 3 | 10 B7 | LVSQaPWWLL | 6202 | 30.000 |
| 117 | HCV | 3a | 21 | 29 | 9 B_3501 | CPPYYLRVL | 6203 | 20.000 |
| 118 | HCV | 3a | 21 | 25 | 9 B_3501 | WSTCCPPYY | 6204 | 10.000 |
| 119 | HCV | 3a | 21 | 7 | 9 B_3501 | APWWLLRSW | 6205 | 10.000 |
| 120 | HCV | 3a | 21 | 13 | 10 B_3501 | RSWEeNSPPL | 6206 | 20.000 |
| 121 | HCV | 3a | 21 | 1 | 9 B_4403 | MELVSQAPW | 6207 | 24.000 |
| 122 | HCV | 3a | 21 | 1 | 10 B_4403 | MELVsQAPWW | 6208 | 36.000 |
| 123 | HCV | 3a | 21 | 16 | 10 B_4403 | EENSpPLRTW | 6209 | 18.000 |
| 124 | HCV | 3a | 23 | 24 | 9 B7 | CPTSSHGSL | 6210 | 80.000 |
| 125 | HCV | 3a | 23 | 24 | 10 B7 | CPTSsHGSLL | 6211 | 80.000 |
| 126 | HCV | 3a | 23 | 24 | 9 B_3501 | CPTSSHGSL | 6212 | 20.000 |
| 127 | HCV | 3a | 23 | 24 | 10 B_3501 | CPTSsHGSLL | 6213 | 20.000 |
| 128 | HCV | 3a | 24 | 38 | 9 A_0201 | TLARYGAWL | 6214 | 117.493 |
| 129 | HCV | 3a | 24 | 78 | 9 A_0201 | LLSSSLKWM | 6215 | 106.837 |
| 130 | HCV | 3a | 24 | 22 | 9 A_0201 | SMSTPPDPV | 6216 | 24.614 |
| 131 | HCV | 3a | 24 | 45 | 9 A_0201 | WLPTATLKC | 6217 | 22.853 |
| 132 | HCV | 3a | 24 | 5 | 9 A_0201 | GLQGRVHVL | 6218 | 20.145 |
| 133 | HCV | 3a | 24 | 77 | 10 A_0201 | RLLSsSLKWM | 6219 | 232.527 |
| 134 | HCV | 3a | 24 | 45 | 10 A_0201 | WLPTaTLKCA | 6220 | 52.561 |
| 135 | HCV | 3a | 24 | 75 | 9 A24 | KYRLLSSSL | 6221 | 480.000 |
| 136 | HCV | 3a | 24 | 41 | 9 A24 | RYGAWLPTA | 6222 | 10.000 |
| 137 | HCV | 3a | 24 | 67 | 10 A3 | KMSSsVRAKY | 6223 | 18.000 |
| 138 | HCV | 3a | 24 | 71 | 9 B7 | SVRAKYRLL | 6224 | 200.000 |
| 139 | HCV | 3a | 24 | 11 | 9 B7 | HVLTCGTVL | 6225 | 20.000 |
| 140 | HCV | 3a | 24 | 43 | 9 B7 | GAWLPTATL | 6226 | 18.000 |
| 141 | HCV | 3a | 24 | 71 | 9 B8 | SVRAKYRLL | 6227 | 80.000 |
| 142 | HCV | 3a | 24 | 68 | 9 B_3501 | MSSSVRAKY | 6228 | 10.000 |
| 143 | HCV | 3a | 24 | 54 | 9 B_4403 | AEWGTSIIL | 6229 | 12.000 |
| 144 | HCV | 3a | 25 | 72 | 10 A1 | WTVPmCPRRY | 6230 | 12.500 |
| 145 | HCV | 3a | 25 | 18 | 9 A_0201 | ILQPFLSGL | 6231 | 317.403 |
| 146 | HCV | 3a | 25 | 22 | 9 A_0201 | FLSGLGQTT | 6232 | 34.279 |
| 147 | HCV | 3a | 25 | 7 | 9 A_0201 | WLQSVSRNL | 6233 | 19.653 |
| 148 | HCV | 3a | 25 | 42 | 10 A_0201 | IMYHqLSMDV | 6234 | 273.262 |
| 149 | HCV | 3a | 25 | 14 | 10 A_0201 | NLPSiLQPFL | 6235 | 117.493 |
| 150 | HCV | 3a | 25 | 17 | 10 A_0201 | SILQpFLSGL | 6236 | 94.987 |
| 151 | HCV | 3a | 25 | 22 | 10 A_0201 | FLSGlGQTTI | 6237 | 47.991 |
| 152 | HCV | 3a | 25 | 25 | 10 A_0201 | GLGQtTILHC | 6238 | 11.426 |
| 153 | HCV | 3a | 25 | 6 | 10 A24 | RWLQsVSRNL | 6239 | 16.800 |
| 154 | HCV | 3a | 25 | 13 | 10 A24 | RNLPsILQPF | 6240 | 12.096 |
| 155 | HCV | 3a | 25 | 31 | 9 A3 | ILHCWTAGK | 6241 | 60.000 |
| 156 | HCV | 3a | 25 | 15 | 9 B7 | LPSILQPFL | 6242 | 80.000 |
| 157 | HCV | 3a | 25 | 11 | 9 B7 | VSRNLPSIL | 6243 | 40.000 |
| 158 | HCV | 3a | 25 | 39 | 9 B7 | KLRIMYHQL | 6244 | 40.000 |
| 159 | HCV | 3a | 25 | 74 | 9 B7 | VPMCPRRYV | 6245 | 27.000 |
| 160 | HCV | 3a | 25 | 50 | 9 B7 | DVPYHHGAL | 6246 | 20.000 |
| 161 | HCV | 3a | 25 | 56 | 9 B7 | GALRRSLLL | 6247 | 12.000 |
| 162 | HCV | 3a | 25 | 10 | 10 B7 | SVSRnLPSIL | 6248 | 20.000 |
| 163 | HCV | 3a | 25 | 56 | 9 B8 | GALRRSLLL | 6249 | 16.000 |
| 164 | HCV | 3a | 25 | 15 | 9 B_3501 | LPSILQPFL | 6250 | 20.000 |
| 165 | HCV | 3a | 25 | 11 | 9 B_3501 | VSRNLPSIL | 6251 | 15.000 |
| 166 | HCV | 3a | 25 | 72 | 10 B_4403 | WTVPmCPRRY | 6252 | 12.000 |
| 167 | HCV | 3a | 25 | 5 | 10 A_0201 | ALTQlSLNRT | 6253 | 17.140 |
| 168 | HCV | 3a | 25 | 20 | 9 A24 | RYTNAATLN | 6254 | 10.000 |
| 169 | HCV | 3a | 25 | 10 | 10 A3 | SLNRtSGWKR | 6255 | 12.000 |
| 170 | HCV | 3a | 25 | 2 | 10 B7 | TPAAlTQLSL | 6256 | 80.000 |
| 171 | HCV | 3a | 25 | 2 | 10 B_3501 | TPAAlTQLSL | 6257 | 20.000 |
| 172 | HCV | 3a | 26 | 5 | 10 A_0201 | ALTQlSLNRT | 6258 | 17.140 |
| 173 | HCV | 3a | 26 | 20 | 9 A24 | RYTNAATLN | 6259 | 10.000 |
| 174 | HCV | 3a | 26 | 10 | 10 A3 | SLNRtSGWKR | 6260 | 12.000 |
| 175 | HCV | 3a | 26 | 2 | 10 B7 | TPAAlTQLSL | 6261 | 80.000 |
| 176 | HCV | 3a | 26 | 2 | 10 B_3501 | TPAAlTQLSL | 6262 | 20.000 |
| 177 | HCV | 3a | 27 | 1 | 9 A_0201 | MIWSWWPRV | 6263 | 229.4 |
| 178 | HCV | 3a | 27 | 6 | 10 B7 | WPRVtASMRM | 6264 | 200 |

TABLE 4i-continued

3a (1-3)

| No. | Strain | ORF | Start | AA | HLA | Peptide sequence | SEQ ID NO: | Score |
|---|---|---|---|---|---|---|---|---|
| 179 | HCV 3a | 27 | 6 | 10 | B_3501 | WPRVtASMRM | 6265 | 120 |
| 180 | HCV 3a | 28 | 1 | 9 | A_0201 | MLHSPPTTL | 6266 | 36.32 |
| 181 | HCV 3a | 29 | 1 | 9 | B_4403 | MDHSPVRNF | 6267 | 15 |
| 182 | HCV 3a | 30 | 6 | 9 | A_0201 | QQLQAHHFL | 6268 | 44.08 |
| 183 | HCV 3a | 30 | 13 | 9 | A_0201 | FLQAGVGSL | 6269 | 29.38 |
| 184 | HCV 3a | 30 | 5 | 10 | A_0201 | AQQLqAHHFL | 6270 | 11.91 |
| 185 | HCV 3a | 30 | 12 | 10 | A24 | HFLQaGVGSL | 6271 | 30 |
| 186 | HCV 3a | 30 | 5 | 10 | B7 | AQQLqAHHFL | 6272 | 12 |
| 187 | HCV 3a | 31 | 16 | 10 | B7 | WVRApVYRRL | 6273 | 200 |
| 188 | HCV 3a | 31 | 18 | 10 | B7 | RAPVyRRLQL | 6274 | 18 |
| 189 | HCV 3a | 31 | 12 | 10 | B7 | DVRGwVRAPV | 6275 | 15 |
| 190 | HCV 3a | 31 | 19 | 9 | B7 | APVYRRLQL | 6276 | 360 |
| 191 | HCV 3a | 31 | 19 | 9 | B8 | APVYRRLQL | 6277 | 16 |
| 192 | HCV 3a | 31 | 24 | 10 | A24 | RLQLdQGGAL | 6278 | 12 |
| 193 | HCV 3a | 31 | 18 | 10 | A24 | RAPVyRRLQL | 6279 | 12 |
| 194 | HCV 3a | 31 | 26 | 10 | A1 | QLDQgGALRY | 6280 | 125 |
| 195 | HCV 3a | 31 | 26 | 9 | A1 | QLDQGGALR | 6281 | 10 |
| 196 | HCV 3a | 32 | 37 | 9 | A1 | LGEPCHAER | 6282 | 45 |
| 197 | HCV 3a | 32 | 37 | 10 | A1 | LGEPcHAERR | 6283 | 22.5 |
| 198 | HCV 3a | 32 | 56 | 10 | A_0201 | LVPGgLLCGV | 6284 | 23.8 |
| 199 | HCV 3a | 32 | 60 | 9 | A_0201 | GLLCGVVRA | 6285 | 42.28 |
| 200 | HCV 3a | 32 | 53 | 9 | A24 | RYRLVPGGL | 6286 | 560 |
| 201 | HCV 3a | 32 | 53 | 10 | A24 | RYRLvPGGLL | 6287 | 400 |
| 202 | HCV 3a | 32 | 68 | 10 | B7 | AGQTcPGGDL | 6288 | 18 |
| 203 | HCV 3a | 32 | 17 | 9 | B7 | GPTRVRCPL | 6289 | 120 |
| 204 | HCV 3a | 33 | | | | no hits | | |
| 205 | HCV 3a | 34 | 4 | 9 | B_3501 | RPPSVGPPL | 6290 | 40 |
| 206 | HCV 3a | 35 | 50 | 9 | A1 | IAEFSNCHK | 6291 | 18 |
| 207 | HCV 3a | 35 | 44 | 10 | A1 | CSEGhRIAEF | 6292 | 27 |
| 208 | HCV 3a | 35 | 30 | 9 | B7 | QPRFTNALC | 6293 | 20 |
| 209 | HCV 3a | 35 | 45 | 9 | B_4403 | SEGHRIAEF | 6294 | 80 |
| 210 | HCV 3a | 35 | 19 | 9 | B_4403 | DEQAHRIRI | 6295 | 12 |
| 211 | HCV 3a | 35 | 51 | 10 | B_4403 | AEFSnCHKPA | 6296 | 12 |
| 212 | HCV 3a | 35 | 45 | 10 | B_4403 | SEGHrIAEFS | 6297 | 12 |
| 213 | HCV 3a | 36 | | | | no hits | | |
| 214 | HCV 3a | 37 | 33 | 10 | B7 | CASGkIISVL | 6298 | 12 |
| 215 | HCV 3a | 37 | 34 | 9 | B7 | ASGKIISVL | 6299 | 12 |
| 216 | HCV 3a | 37 | 16 | 10 | B_4403 | EEKNnSAGRF | 6300 | 60 |
| 217 | HCV 3a | 38 | 15 | 10 | A1 | GLELrLLVHR | 6301 | 18 |
| 218 | HCV 3a | 38 | 15 | 10 | A3 | GLELrLLVHR | 6302 | 18 |
| 219 | HCV 3a | 38 | 11 | 10 | B7 | TGRSgLELRL | 6303 | 40 |
| 220 | HCV 3a | 38 | 8 | 9 | B7 | RGRTGRSGL | 6304 | 60 |
| 221 | HCV 3a | 38 | 13 | 9 | B_3501 | RSGLELRLL | 6305 | 15 |

TABLE 4j

3a (4-6)

| No. | Strain | ORF | Start | AA | HLA | Peptide sequence | SEQ ID NO: | Score |
|---|---|---|---|---|---|---|---|---|
| 1 | HCV 3a | 1 | | | | no hits | | |
| 2 | HCV 3a | 2 | 1 | 9 | A_0201 | MVVEHLQSV | 6349 | 97.561 |
| 3 | HCV 3a | 2 | 7 | 9 | B_3501 | QSVEGNLPL | 6350 | 10.000 |
| 4 | HCV 3a | 3 | 15 | 9 | A_0201 | FLLLSTTRC | 6351 | 84.555 |
| 5 | HCV 3a | 3 | 8 | 9 | A_0201 | AEWADGQFL | 6352 | 18.962 |
| 6 | HCV 3a | 3 | 54 | 9 | B7 | QVRIARFSL | 6353 | 300.000 |
| 7 | HCV 3a | 3 | 28 | 9 | B7 | GPRVRHRAA | 6354 | 20.000 |
| 8 | HCV 3a | 3 | 34 | 9 | B7 | RAADHALLL | 6355 | 12.000 |
| 9 | HCV 3a | 3 | 28 | 9 | B8 | GPRVRHRAA | 6356 | 16.000 |
| 10 | HCV 3a | 3 | 34 | 9 | B_3501 | RAADHALLL | 6357 | 12.000 |
| 11 | HCV 3a | 3 | 8 | 10 | A_0201 | AEWAdGQFLL | 6358 | 19.996 |
| 12 | HCV 3a | 3 | 53 | 10 | A_0201 | TQVRiARFSL | 6359 | 12.562 |
| 13 | HCV 3a | 3 | 48 | 10 | B7 | GPRVaTQVRI | 6360 | 80.000 |
| 14 | HCV 3a | 3 | 48 | 10 | B_3501 | GPRVaTQVRI | 6361 | 24.000 |
| 15 | HCV 3a | 3 | 8 | 10 | B_4403 | AEWAdGQFLL | 6362 | 12.000 |
| 16 | HCV 3a | 4 | 32 | 9 | A_0201 | ILGRFLETL | 6363 | 155.527 |
| 17 | HCV 3a | 4 | 6 | 9 | A_0201 | YIIRSFPAV | 6364 | 83.584 |
| 18 | HCV 3a | 4 | 20 | 9 | A3 | VVWPSPDRK | 6365 | 15.000 |
| 19 | HCV 3a | 4 | 22 | 9 | B_3501 | WPSPDRKGW | 6366 | 15.000 |
| 20 | HCV 3a | 4 | 39 | 10 | A_0201 | TLCShRELGV | 6367 | 69.552 |
| 21 | HCV 3a | 4 | 31 | 10 | A_0201 | RILGrFLETL | 6368 | 46.544 |
| 22 | HCV 3a | 4 | 31 | 10 | A24 | RILGrFLETL | 6369 | 12.000 |

TABLE 4j-continued 3a (4-6)

| No. | Strain | ORF | Start | AA | HLA | Peptide sequence | SEQ ID NO: | Score |
|---|---|---|---|---|---|---|---|---|
| 23 | HCV 3a | 4 | 24 | 10 | B7 | SPDRkGWRIL | 6370 | 24.000 |
| 24 | HCV 3a | 5 | 2 | 9 | A24 | RPMRLASGL | 6371 | 14.400 |
| 25 | HCV 3a | 5 | 2 | 9 | B7 | RPMRLASGL | 6372 | 240.000 |
| 26 | HCV 3a | 5 | 2 | 9 | B_3501 | RPMRLASGL | 6373 | 40.000 |
| 27 | HCV 3a | 6 | 30 | 9 | B7 | QPYRESDLL | 6374 | 80.000 |
| 28 | HCV 3a | 6 | 30 | 9 | B_3501 | QPYRESDLL | 6375 | 30.000 |
| 29 | HCV 3a | 6 | 9 | 10 | A_0201 | GQHRnIWFWL | 6376 | 117.457 |
| 30 | HCV 3a | 6 | 23 | 10 | B_3501 | RSYRvGIQPY | 6377 | 20.000 |
| 31 | HCV 3a | 7 | 1 | 9 | B_4403 | MEVPHSAHF | 6378 | 160.000 |
| 32 | HCV 3a | 8 | 33 | 9 | B7 | QPGERWHNL | 6379 | 80.000 |
| 33 | HCV 3a | 8 | 15 | 9 | B7 | HAVPPPHAL | 6380 | 18.000 |
| 34 | HCV 3a | 8 | 33 | 9 | B8 | QPGERWHNL | 6381 | 24.000 |
| 35 | HCV 3a | 8 | 33 | 9 | B_3501 | QPGERWHNL | 6382 | 40.000 |
| 36 | HCV 3a | 8 | 30 | 9 | B_4403 | NEGQPGERW | 6383 | 12.000 |
| 37 | HCV 3a | 8 | 17 | 10 | B7 | VPPPhALVSL | 6384 | 80.000 |
| 38 | HCV 3a | 8 | 17 | 10 | B_3501 | VPPPhALVSL | 6385 | 20.000 |
| 39 | HCV 3a | 9 | | | | no hits | | |
| 40 | HCV 3a | 10 | 28 | 9 | A_0201 | LQQSKDFFL | 6386 | 117.457 |
| 41 | HCV 3a | 10 | 44 | 9 | A_0201 | SLLDVRGGL | 6387 | 42.129 |
| 42 | HCV 3a | 10 | 1 | 9 | A_0201 | MLVPEGLKL | 6388 | 36.316 |
| 43 | HCV 3a | 10 | 2 | 9 | A_0201 | LVPEGLKLL | 6389 | 29.965 |
| 44 | HCV 3a | 10 | 14 | 9 | A24 | SYYGLNDSL | 6390 | 240.000 |
| 45 | HCV 3a | 10 | 15 | 9 | A24 | YYGLNDSLL | 6391 | 200.000 |
| 46 | HCV 3a | 10 | 44 | 9 | A24 | SLLDVRGGL | 6392 | 10.080 |
| 47 | HCV 3a | 10 | 8 | 9 | A3 | KLLPVGSYY | 6393 | 40.500 |
| 48 | HCV 3a | 10 | 10 | 9 | B7 | LPVGSYYGL | 6394 | 80.000 |
| 49 | HCV 3a | 10 | 38 | 9 | B7 | LVGYCLSLL | 6395 | 20.000 |
| 50 | HCV 3a | 10 | 2 | 9 | B7 | LVPEGLKLL | 6396 | 20.000 |
| 51 | HCV 3a | 10 | 30 | 9 | B_3501 | QSKDFFLEL | 6397 | 30.000 |
| 52 | HCV 3a | 10 | 10 | 9 | B_3501 | LPVGSYYGL | 6398 | 20.000 |
| 53 | HCV 3a | 10 | 27 | 10 | A_0201 | SLQQsKDFFL | 6399 | 681.461 |
| 54 | HCV 3a | 10 | 1 | 10 | A_0201 | MLVPeGLKLL | 6400 | 83.527 |
| 55 | HCV 3a | 10 | 9 | 10 | A_0201 | LLPVgSYYGL | 6401 | 54.474 |
| 56 | HCV 3a | 10 | 29 | 10 | A_0201 | QQSKdFFLEL | 6402 | 15.638 |
| 57 | HCV 3a | 10 | 15 | 10 | A24 | YYGLnDSLLL | 6403 | 200.000 |
| 58 | HCV 3a | 10 | 14 | 10 | A24 | SYYGLNDSLL | 6404 | 200.000 |
| 59 | HCV 3a | 10 | 34 | 10 | A24 | FFLELVGYCL | 6405 | 50.400 |
| 60 | HCV 3a | 10 | 23 | 10 | A3 | LLGGsLQQSK | 6406 | 30.000 |
| 61 | HCV 3a | 10 | 6 | 10 | A3 | GLKLlPVGSY | 6407 | 16.200 |
| 62 | HCV 3a | 10 | 32 | 10 | B_4403 | KDFFLELVGY | 6408 | 22.500 |
| 63 | HCV 3a | 10 | 15 | 10 | A24 | YYGLnDSLLL | 6409 | 200.000 |
| 64 | HCV 3a | 10 | 14 | 10 | A24 | SYYGLNDSLL | 6410 | 200.000 |
| 65 | HCV 3a | 10 | 34 | 10 | A24 | FFLElVGYCL | 6411 | 50.400 |
| 66 | HCV 3a | 10 | 23 | 10 | A3 | LLGGsLQQSK | 6412 | 30.000 |
| 67 | HCV 3a | 10 | 6 | 10 | A3 | GLKLLPVGSY | 6413 | 16.200 |
| 68 | HCV 3a | 10 | 32 | 10 | B_4403 | KDFFlELVGY | 6414 | 22.500 |
| 69 | HCV 3a | 11 | | | | no hits | | |
| 70 | HCV 3a | 12 | 27 | 9 | A_0201 | RAQGHFFDV | 6415 | 10.645 |
| 71 | HCV 3a | 12 | 25 | 9 | A24 | TFRAQGHFF | 6416 | 10.000 |
| 72 | HCV 3a | 12 | 6 | 9 | B_3501 | VPPPLEQGY | 6417 | 40.000 |
| 73 | HCV 3a | 12 | 15 | 10 | A24 | RYSLtVEGDL | 6418 | 560.000 |
| 74 | HCV 3a | 12 | 1 | 10 | B7 | MAKDkVPPPL | 6419 | 12.000 |
| 75 | HCV 3a | 12 | 1 | 10 | B8 | MAKDkVPPPL | 6420 | 24.000 |
| 76 | HCV 3a | 12 | 1 | 10 | B_3501 | MAKDkVPPPL | 6421 | 18.000 |
| 77 | HCV 3a | 13 | 14 | 9 | B7 | GATPVREKL | 6422 | 18.000 |
| 78 | HCV 3a | 13 | 19 | 9 | B_4403 | REKLTVGGI | 6423 | 12.000 |
| 79 | HCV 3a | 13 | 9 | 10 | A_0201 | IVCPpGATPV | 6424 | 10.346 |
| 80 | HCV 3a | 14 | 5 | 10 | A3 | YLIALWNSRR | 6425 | 18.000 |
| 81 | HCV 3a | 15 | 32 | 9 | B7 | APSRDDIGI | 6426 | 24.000 |
| 82 | HCV 3a | 15 | 1 | 9 | B7 | MPRRAHNRT | 6427 | 20.000 |
| 83 | HCV 3a | 15 | 32 | 9 | B_3501 | APSRDDIGI | 6428 | 12.000 |
| 84 | HCV 3a | 15 | 29 | 10 | B7 | VPPApSRDDI | 6429 | 12.000 |
| 85 | HCV 3a | 15 | 36 | 10 | B_4403 | DDIGiAGNQV | 6430 | 16.875 |
| 86 | HCV 3a | 16 | 16 | 9 | B7 | SPRNPPHCC | 6431 | 30.000 |
| 87 | HCV 3a | 16 | 3 | 9 | B8 | GARERSRTC | 6432 | 24.000 |
| 88 | HCV 3a | 16 | 16 | 10 | B7 | SPRNpPHCCT | 6433 | 30.000 |
| 89 | HCV 3a | 17 | 43 | 9 | B_4403 | CEIDCTWVM | 6434 | 30.000 |
| 90 | HCV 3a | 17 | 35 | 9 | B_4403 | HEHPHLEQC | 6435 | 12.000 |
| 91 | HCV 3a | 17 | 50 | 9 | A_0201 | VMPKPVWIV | 6436 | 603.952 |
| 92 | HCV 3a | 17 | 2 | 9 | A_0201 | QQWMLLAAV | 6437 | 134.619 |
| 93 | HCV 3a | 17 | 4 | 9 | A_0201 | WMLLAAVTI | 6438 | 128.242 |
| 94 | HCV 3a | 17 | 49 | 9 | A_0201 | WVMPKPVWI | 6439 | 85.454 |
| 95 | HCV 3a | 17 | 56 | 9 | A_0201 | WIVDHAAGC | 6440 | 12.883 |
| 96 | HCV 3a | 17 | 32 | 9 | B7 | EPTHEHPHL | 6441 | 80.000 |
| 97 | HCV 3a | 17 | 71 | 9 | B7 | TPAVCGLRM | 6442 | 20.000 |

TABLE 4j-continued 3a (4-6)

| No. | Strain | ORF | Start | AA | HLA | Peptide sequence | SEQ ID NO: | Score |
|---|---|---|---|---|---|---|---|---|
| 98 | HCV 3a | 17 | 67 | 9 | B7 | GPRTTPAVC | 6443 | 20.000 |
| 99 | HCV 3a | 17 | 23 | 9 | B7 | VASGGKPVL | 6444 | 12.000 |
| 100 | HCV 3a | 17 | 71 | 9 | B_3501 | TPAVCGLRM | 6445 | 40.000 |
| 101 | HCV 3a | 17 | 32 | 9 | B_3501 | EPTHEHPHL | 6446 | 30.000 |
| 102 | HCV 3a | 17 | 37 | 9 | B_3501 | HPHLEQCEI | 6447 | 12.000 |
| 103 | HCV 3a | 17 | 43 | 9 | B_4403 | CEIDCTWVM | 6448 | 30.000 |
| 104 | HCV 3a | 17 | 35 | 9 | B_4403 | HEHPHLEQC | 6449 | 12.000 |
| 105 | HCV 3a | 17 | 44 | 10 | A1 | EIDCtWVMPK | 6450 | 50.000 |
| 106 | HCV 3a | 17 | 49 | 10 | A_0201 | WVMPkPVWIV | 6451 | 732.572 |
| 107 | HCV 3a | 17 | 6 | 10 | A_0201 | LLAAvTIFDI | 6452 | 236.595 |
| 108 | HCV 3a | 17 | 1 | 10 | A_0201 | MQQWmLLAAV | 6453 | 27.573 |
| 109 | HCV 3a | 17 | 41 | 10 | A_0201 | EQCEiDCTWV | 6454 | 11.926 |
| 110 | HCV 3a | 17 | 44 | 10 | A3 | EIDCtWVMPK | 6455 | 10.800 |
| 111 | HCV 3a | 17 | 9 | 10 | B7 | AVTIFDIAAL | 6456 | 60.000 |
| 112 | HCV 3a | 17 | 71 | 10 | B_3501 | TPAVcGLRMF | 6457 | 20.000 |
| 113 | HCV 3a | 17 | 40 | 10 | B_4403 | LEQCeIDCTW | 6458 | 12.000 |
| 114 | HCV 3a | 18 | 4 | 9 | A_0201 | KQPSYEPGV | 6459 | 24.681 |
| 115 | HCV 3a | 18 | 32 | 9 | A_0201 | NQLQFLLGA | 6460 | 16.289 |
| 116 | HCV 3a | 18 | 15 | 9 | A_0201 | LITVQGSAV | 6461 | 16.258 |
| 117 | HCV 3a | 18 | 30 | 9 | A_0201 | GVNQLQFLL | 6462 | 10.841 |
| 118 | HCV 3a | 18 | 7 | 9 | A24 | SYEPGVYGL | 6463 | 360.000 |
| 119 | HCV 3a | 18 | 36 | 9 | A3 | FLLGAHTKK | 6464 | 45.000 |
| 120 | HCV 3a | 18 | 30 | 9 | B7 | GVNQLQFLL | 6465 | 20.000 |
| 121 | HCV 3a | 18 | 5 | 9 | B_3501 | QPSYEPGVY | 6466 | 60.000 |
| 122 | HCV 3a | 18 | 44 | 9 | B_3501 | KASKPSGGM | 6467 | 12.000 |
| 123 | HCV 3a | 18 | 36 | 10 | A_0201 | FLLGaHTKKA | 6468 | 84.555 |
| 124 | HCV 3a | 18 | 14 | 10 | A_0201 | GLITvQGSAV | 6469 | 69.552 |
| 125 | HCV 3a | 18 | 28 | 10 | A_0201 | AIGVnQLQFL | 6470 | 37.157 |
| 126 | HCV 3a | 18 | 7 | 10 | A24 | SYEPgVYGLI | 6471 | 126.000 |
| 127 | HCV 3a | 18 | 25 | 10 | B7 | VPRAiGVNQL | 6472 | 800.000 |
| 128 | HCV 3a | 18 | 28 | 10 | B7 | AIGVnQLQFL | 6473 | 12.000 |
| 129 | HCV 3a | 18 | 25 | 10 | B8 | VPRAiGVNQL | 6474 | 16.000 |
| 130 | HCV 3a | 18 | 25 | 10 | B_3501 | VPRAiGVNQL | 6475 | 60.000 |
| 131 | HCV 3a | 19 | 10 | 9 | A3 | GLGHPQDVR | 6476 | 18.000 |
| 132 | HCV 3a | 19 | 2 | 10 | B7 | GPGYyVEQGL | 6477 | 80.000 |
| 133 | HCV 3a | 19 | 2 | 10 | B_3501 | GPGYyVEQGL | 6478 | 20.000 |
| 134 | HCV 3a | 20 | 34 | 9 | A24 | RYAAGCVQN | 6479 | 10.000 |
| 135 | HCV 3a | 20 | 39 | 9 | B7 | CVQNDVIGL | 6480 | 20.000 |
| 136 | HCV 3a | 20 | 23 | 9 | B7 | PARGYIVVL | 6481 | 12.000 |
| 137 | HCV 3a | 20 | 22 | 10 | B7 | GPARgYIVVL | 6482 | 80.000 |
| 138 | HCV 3a | 20 | 22 | 10 | B_3501 | GPARgYIVVL | 6483 | 20.000 |
| 139 | HCV 3a | 21 | 65 | 9 | A_0201 | LITIEGPRV | 6484 | 16.258 |
| 140 | HCV 3a | 21 | 83 | 9 | A_0201 | ALTRLGDRL | 6485 | 10.468 |
| 141 | HCV 3a | 21 | 57 | 9 | B7 | EPPCPPAAL | 6486 | 120.000 |
| 142 | HCV 3a | 21 | 79 | 9 | B7 | GPASALTRL | 6487 | 80.000 |
| 143 | HCV 3a | 21 | 83 | 9 | B7 | ALTRLGDRL | 6488 | 12.000 |
| 144 | HCV 3a | 21 | 57 | 9 | B_3501 | EPPCPPAAL | 6489 | 20.000 |
| 145 | HCV 3a | 21 | 79 | 9 | B_3501 | GPASALTRL | 6490 | 20.000 |
| 146 | HCV 3a | 21 | 68 | 9 | B_4403 | IEGPRVPGL | 6491 | 24.000 |
| 147 | HCV 3a | 21 | 14 | 9 | B_4403 | DERDVPHEV | 6492 | 18.000 |
| 148 | HCV 3a | 21 | 64 | 10 | A_0201 | ALITiEGPRV | 6493 | 69.552 |
| 149 | HCV 3a | 21 | 75 | 10 | A_0201 | GLSPgPASAL | 6494 | 21.362 |
| 150 | HCV 3a | 21 | 86 | 10 | A_0201 | RLGDrLSSSA | 6495 | 20.369 |
| 151 | HCV 3a | 21 | 43 | 10 | A_0201 | VIWApRWTGA | 6496 | 16.386 |
| 152 | HCV 3a | 21 | 82 | 10 | B7 | SALTrLGDRL | 6497 | 12.000 |
| 153 | HCV 3a | 21 | 57 | 10 | B7 | EPPCpPAALI | 6498 | 12.000 |
| 154 | HCV 3a | 21 | 68 | 10 | B_4403 | IEGPrVPGLS | 6499 | 12.000 |
| 155 | HCV 3a | 22 | 14 | 9 | A_0201 | QGSDPWWSV | 6500 | 23.734 |
| 156 | HCV 3a | 22 | 5 | 9 | B_3501 | FPREDRSSS | 6501 | 18.000 |
| 157 | HCV 3a | 22 | 15 | 10 | A1 | GSDPwWSVAS | 6502 | 15.000 |
| 158 | HCV 3a | 22 | 13 | 10 | A_0201 | SQGSdPWWSV | 6503 | 89.910 |
| 159 | HCV 3a | 23 | 2 | 9 | A_0201 | SMTLSRTPL | 6504 | 15.428 |
| 160 | HCV 3a | 23 | 1 | 10 | B7 | MSMTLSRTPL | 6505 | 18.000 |
| 161 | HCV 3a | 23 | 8 | 10 | B_3501 | TPLPgRGAPW | 6506 | 10.000 |
| 162 | HCV 3a | 24 | 42 | 9 | A_0201 | QLVVHNPEL | 6507 | 21.362 |
| 163 | HCV 3a | 24 | 35 | 9 | B7 | VVRHIHGQL | 6508 | 200.000 |
| 164 | HCV 3a | 24 | 53 | 9 | B7 | GPTVEDCSL | 6509 | 80.000 |
| 165 | HCV 3a | 24 | 53 | 9 | B_3501 | GPTVEDCSL | 6510 | 30.000 |
| 166 | HCV 3a | 24 | 26 | 9 | B_4403 | EEGPAERPV | 6511 | 12.000 |
| 167 | HCV 3a | 24 | 23 | 10 | A1 | SSEEeGPAER | 6512 | 27.000 |
| 168 | HCV 3a | 24 | 34 | 10 | B7 | VVVRhIHGQL | 6513 | 20.000 |
| 169 | HCV 3a | 24 | 9 | 10 | B7 | TPRThWNRPA | 6514 | 20.000 |
| 170 | HCV 3a | 24 | 35 | 10 | B7 | VVRHiNGQLV | 6515 | 10.000 |
| 171 | HCV 3a | 24 | 30 | 10 | B_4403 | AERPvVVRHI | 6516 | 72.000 |
| 172 | HCV 3a | 25 | | | | no hits | | |

TABLE 4j-continued

| | | | | 3a (4-6) | | | |
|---|---|---|---|---|---|---|---|
| No. | Strain | ORF | Start | AA | HLA | Peptide sequence | SEQ ID NO: | Score |
| 173 | HCV 3a | 26 | | | | no hits | | |
| 174 | HCV 3a | 27 | | | | no hits | | |
| 175 | HCV 3a | 28 | 3 | 9 | A_0201 | KVYWVRWCT | 6517 | 54.772 |
| 176 | HCV 3a | 29 | 17 | 9 | A_0201 | LLLPRKDSV | 6518 | 214.366 |
| 177 | HCV 3a | 29 | 19 | 9 | B7 | LPRKDSVST | 6519 | 20.000 |
| 178 | HCV 3a | 29 | 30 | 9 | B7 | RPPATRPCI | 6520 | 12.000 |
| 179 | HCV 3a | 29 | 30 | 9 | B_3501 | RPPATRPCI | 6521 | 16.000 |
| 180 | HCV 3a | 29 | 16 | 10 | A_0201 | RLLLpRKDSV | 6522 | 126.098 |
| 181 | HCV 3a | 29 | 18 | 10 | A_0201 | LLPRkDSVST | 6523 | 12.668 |
| 182 | HCV 3a | 30 | 5 | 9 | A_0201 | YLGPYGHDV | 6524 | 319.939 |
| 183 | HCV 3a | 30 | 12 | 9 | B7 | DVGCGKPHL | 6525 | 20.000 |
| 184 | HCV 3a | 31 | 16 | 9 | B7 | WNRSVWHQL | 6526 | 40.000 |
| 185 | HCV 3a | 31 | 8 | 9 | B_3501 | RPRETYRRW | 6527 | 120.000 |
| 186 | HCV 3a | 31 | 15 | 10 | A24 | RWNRsVWHQL | 6528 | 16.800 |
| 187 | HCV 3a | 31 | 8 | 10 | B_3501 | RPREtYRRWN | 6529 | 24.000 |
| 188 | HCV 3a | 31 | 4 | 10 | B_3501 | RSNPrPRETY | 6530 | 20.000 |
| 189 | HCV 3a | 32 | 41 | 9 | B_4403 | EELNCQRKM | 6531 | 12.000 |
| 190 | HCV 3a | 32 | 23 | 10 | B7 | RCRSgHEGIL | 6532 | 40.000 |
| 191 | HCV 3a | 32 | 11 | 10 | B7 | VPRKrPGPLC | 6533 | 30.000 |
| 192 | HCV 3a | 32 | 10 | 10 | B7 | LVPRkRPGPL | 6534 | 20.000 |
| 193 | HCV 3a | 33 | | | | no hits | | |
| 194 | HCV 3a | 34 | 19 | 9 | B_3501 | RAPHHTGCM | 6535 | 12.000 |
| 195 | HCV 3a | 34 | 20 | 9 | B_3501 | APHHTGCMW | 6536 | 10.000 |
| 196 | HCV 3a | 34 | 7 | 10 | A_0201 | GMDSrPCSGV | 6537 | 20.093 |
| 197 | HCV 3a | 35 | | | | no hits | | |
| 198 | HCV 3a | 36 | | | | no hits | | |
| 199 | HCV 3a | 37 | 27 | 9 | A1 | RAEPRTGLR | 6538 | 90.000 |
| 200 | HCV 3a | 37 | 27 | 10 | A1 | RAEPrTGLRS | 6539 | 45.000 |
| 201 | HCV 3a | 37 | 10 | 10 | A1 | ATLPtRSPHY | 6540 | 25.000 |
| 202 | HCV 3a | 37 | 25 | 10 | B7 | GTRAePRTGL | 6541 | 90.000 |
| 203 | HCV 3a | 37 | 3 | 10 | B7 | GSRAgTGATL | 6542 | 40.000 |
| 204 | HCV 3a | 37 | 29 | 10 | B7 | EPRTgLRSDA | 6543 | 30.000 |
| 205 | HCV 3a | 37 | 3 | 10 | B_3501 | GSRAgTGATL | 6544 | 15.000 |
| 206 | HCV 3a | 37 | 10 | 10 | B_4403 | ATLPtRSPHY | 6545 | 24.000 |
| 207 | HCV 3a | 38 | 8 | 9 | A1 | GLEAARHSY | 6546 | 45.000 |
| 208 | HCV 3a | 38 | 8 | 9 | A3 | GLEAARHSY | 6547 | 12.000 |
| 209 | HCV 3a | 38 | 1 | 9 | B7 | MALPGGGGL | 6548 | 12.000 |
| 210 | HCV 3a | 39 | | | | no hits | | |
| 211 | HCV 3a | 40 | 26 | 9 | A_0201 | LVLVRTAQL | 6549 | 11.757 |
| 212 | HCV 3a | 40 | 11 | 9 | A_0201 | QMDKSNWPA | 6550 | 10.764 |
| 213 | HCV 3a | 40 | 20 | 9 | A24 | RGSGVSLVL | 6551 | 11.200 |
| 214 | HCV 3a | 40 | 27 | 9 | A3 | VLVRTAQLK | 6552 | 30.000 |
| 215 | HCV 3a | 40 | 26 | 9 | B7 | LVLVRTAQL | 6553 | 20.000 |
| 216 | HCV 3a | 40 | 18 | 9 | B7 | PARGSGVSL | 6554 | 12.000 |
| 217 | HCV 3a | 40 | 10 | 10 | A_0201 | NQMDkSNWPA | 6555 | 57.308 |
| 218 | HCV 3a | 40 | 25 | 10 | A_0201 | SLVLvRTAQL | 6556 | 21.362 |
| 219 | HCV 3a | 40 | 27 | 10 | A3 | VLVRtAQLKR | 6557 | 12.000 |
| 220 | HCV 3a | 40 | 17 | 10 | B7 | WPARgSGVSL | 6558 | 80.000 |
| 221 | HCV 3a | 40 | 3 | 10 | B7 | FPPTpTVNQM | 6559 | 20.000 |
| 222 | HCV 3a | 40 | 3 | 10 | B_3501 | FPPTpTVNQM | 6560 | 40.000 |
| 223 | HCV 3a | 40 | 17 | 10 | B_3501 | WPARgSGVSL | 6561 | 20.000 |
| 224 | HCV 3a | 41 | 1 | 9 | A_0201 | MIAGKSSGV | 6562 | 16.258 |
| 225 | HCV 3a | 42 | 19 | 9 | A_0201 | MMMLPNQEL | 6563 | 97.045 |
| 226 | HCV 3a | 42 | 20 | 9 | A_0201 | MMLPNQELT | 6564 | 16.588 |
| 227 | HCV 3a | 42 | 7 | 9 | A_0201 | IITMRTQMV | 6565 | 16.258 |
| 228 | HCV 3a | 42 | 14 | 9 | B7 | MVGAYMMML | 6566 | 20.000 |
| 229 | HCV 3a | 42 | 19 | 9 | B7 | MMMLPNQEL | 6567 | 18.000 |
| 230 | HCV 3a | 42 | 1 | 9 | B_4403 | MEKKCVIIT | 6568 | 12.000 |
| 231 | HCV 3a | 42 | 21 | 10 | A_0201 | MLPNqELTGV | 6569 | 271.948 |
| 232 | HCV 3a | 42 | 18 | 10 | A_0201 | YMMMlPNQEL | 6570 | 262.591 |
| 233 | HCV 3a | 42 | 13 | 10 | A_0201 | QMVGaYMMML | 6571 | 35.485 |
| 234 | HCV 3a | 42 | 19 | 10 | A_0201 | MMMLpNQELT | 6572 | 16.588 |
| 235 | HCV 3a | 42 | 6 | 10 | A_0201 | VIITmRTQMV | 6573 | 16.258 |
| 236 | HCV 3a | 42 | 13 | 10 | A3 | QMVGaYMMML | 6574 | 12.150 |
| 237 | HCV 3a | 42 | 18 | 10 | B7 | YMMMLPNQEL | 6575 | 18.000 |
| 238 | HCV 3a | 43 | 13 | 9 | A_0201 | VSYENPKGV | 6576 | 10.126 |
| 239 | HCV 3a | 43 | 14 | 9 | A24 | SYENPKGVF | 6577 | 150.000 |
| 240 | HCV 3a | 43 | 20 | 9 | B7 | GVFFEVHIL | 6578 | 20.000 |
| 241 | HCV 3a | 43 | 17 | 9 | B_3501 | NPKGVFFEV | 6579 | 12.000 |
| 242 | HCV 3a | 43 | 15 | 9 | B_4403 | YENPKGVFF | 6580 | 120.000 |
| 243 | HCV 3a | 43 | 7 | 9 | B_4403 | VESKQRVSY | 6581 | 120.000 |
| 244 | HCV 3a | 43 | 6 | 10 | A1 | TVESkQRVSY | 6582 | 90.000 |
| 245 | HCV 3a | 43 | 14 | 10 | A24 | SYENpKGVFF | 6583 | 150.000 |
| 246 | HCV 3a | 43 | 19 | 10 | A24 | KGVFfEVHIL | 6584 | 12.000 |
| 247 | HCV 3a | 43 | 13 | 10 | B_3501 | VSYEnPKGVF | 6585 | 10.000 |

TABLE 4j-continued 3a (4-6)

| No. | Strain | ORF | Start | AA | HLA | Peptide sequence | SEQ ID NO: | Score |
|---|---|---|---|---|---|---|---|---|
| 248 | HCV 3a | 44 | 16 | 9 | A_0201 | SQTERIWLM | 6586 | 35.624 |
| 249 | HCV 3a | 44 | 35 | 9 | A_0201 | ALYPNFDRA | 6587 | 14.801 |
| 250 | HCV 3a | 44 | 1 | 9 | A_0201 | MMVVGIGVV | 6588 | 10.468 |
| 251 | HCV 3a | 44 | 29 | 9 | B_4403 | KERTSFALY | 6589 | 120.000 |
| 252 | HCV 3a | 44 | 1 | 10 | A_0201 | MMVVgIGVVV | 6590 | 35.012 |
| 253 | HCV 3a | 44 | 26 | 10 | A_0201 | LLDKeRTSFA | 6591 | 18.580 |
| 254 | HCV 3a | 44 | 20 | 10 | A3 | RIWLmALLDK | 6592 | 30.000 |
| 255 | HCV 3a | 44 | 14 | 10 | B_3501 | KSSQtERIWL | 6593 | 15.000 |
| 256 | HCV 3a | 44 | 15 | 10 | B_3501 | SSQTeRIWLM | 6594 | 10.000 |
| 257 | HCV 3a | 45 | 7 | 9 | A_0201 | FTLDARSFT | 6595 | 39.723 |
| 258 | HCV 3a | 45 | 1 | 9 | A_0201 | MVSMRAFTL | 6596 | 18.430 |
| 259 | HCV 3a | 45 | 13 | 9 | A24 | SFTSFNTVL | 6597 | 20.000 |
| 260 | HCV 3a | 45 | 6 | 9 | A24 | AFTLDARSF | 6598 | 10.000 |
| 261 | HCV 3a | 45 | 1 | 9 | B7 | MVSMRAFTL | 6599 | 20.000 |
| 262 | HCV 3a | 45 | 9 | 9 | B_4403 | LDARSFTSF | 6600 | 15.000 |
| 263 | HCV 3a | 45 | 12 | 10 | B_3501 | RSFTsFNTVL | 6601 | 10.000 |
| 264 | HCV 3a | 46 | 35 | 9 | A1 | TVDQESQLK | 6602 | 10.000 |
| 265 | HCV 3a | 46 | 27 | 9 | A_0201 | TLCSSLSLT | 6603 | 17.140 |
| 266 | HCV 3a | 46 | 101 | 9 | B7 | SARNAADTL | 6604 | 120.000 |
| 267 | HCV 3a | 46 | 64 | 9 | B7 | SPPGEGGTL | 6605 | 80.000 |
| 268 | HCV 3a | 46 | 78 | 9 | B7 | CVSTPEEEL | 6606 | 30.000 |
| 269 | HCV 3a | 46 | 101 | 9 | B8 | SARNAADTL | 6607 | 16.000 |
| 270 | HCV 3a | 46 | 64 | 9 | B_3501 | SPPGEGGTL | 6608 | 30.000 |
| 271 | HCV 3a | 46 | 84 | 9 | B_4403 | EELFSSCGF | 6609 | 80.000 |
| 272 | HCV 3a | 46 | 56 | 9 | B_4403 | DEHDSESDS | 6610 | 12.000 |
| 273 | HCV 3a | 46 | 8 | 10 | A_0201 | ALHGvIRAPV | 6611 | 69.552 |
| 274 | HCV 3a | 46 | 27 | 10 | A_0201 | TLCSsLSLTV | 6612 | 69.552 |
| 275 | HCV 3a | 46 | 33 | 10 | A_0201 | SLTVdQESQL | 6613 | 21.362 |
| 276 | HCV 3a | 46 | 70 | 10 | A_0201 | GTLEvVLDCV | 6614 | 16.515 |
| 277 | HCV 3a | 46 | 19 | 10 | A24 | EYDIeQQTTL | 6615 | 200.000 |
| 278 | HCV 3a | 46 | 46 | 10 | B7 | SPGSpSRGGM | 6616 | 30.000 |
| 279 | HCV 3a | 46 | 100 | 10 | B7 | ASARnAADTL | 6617 | 12.000 |
| 280 | HCV 3a | 46 | 46 | 10 | B_3501 | SPGSpSRGGM | 6618 | 40.000 |
| 281 | HCV 3a | 46 | 83 | 10 | B_4403 | EEELfSSCGF | 6619 | 40.000 |
| 282 | HCV 3a | 47 | 2 | 10 | A3 | LLPIsCRHNK | 6620 | 20.000 |
| 283 | HCV 3a | 47 | 3 | 10 | B7 | LPIScRHNKL | 6621 | 80.000 |
| 284 | HCV 3a | 47 | 6 | 10 | B8 | SCRHnKLAFT | 6622 | 16.000 |
| 285 | HCV 3a | 47 | 3 | 10 | B8 | LPIScRHNKL | 6623 | 16.000 |
| 286 | HCV 3a | 47 | 3 | 10 | B_3501 | LPIScRHNKL | 6624 | 20.000 |
| 287 | HCV 3a | 48 | 11 | 9 | B7 | HVRGPASRM | 6625 | 75.000 |
| 288 | HCV 3a | 48 | 14 | 9 | B_3501 | GPASRMDPF | 6626 | 20.000 |
| 289 | HCV 3a | 48 | 3 | 10 | A_0201 | KVPChMLAHV | 6627 | 48.991 |
| 290 | HCV 3a | 48 | 14 | 10 | B_3501 | GPASrMDPFF | 6628 | 20.000 |
| 291 | HCV 3a | 49 | 10 | 9 | A_0201 | IILAESHDL | 6629 | 18.476 |
| 292 | HCV 3a | 49 | 29 | 9 | A_0201 | QMIRSQSSL | 6630 | 15.428 |
| 293 | HCV 3a | 49 | 32 | 9 | A24 | RSQSSLQGL | 6631 | 14.400 |
| 294 | HCV 3a | 49 | 11 | 9 | A3 | ILAESHDLK | 6632 | 30.000 |
| 295 | HCV 3a | 49 | 4 | 9 | B7 | SPGSAGIIL | 6633 | 80.000 |
| 296 | HCV 3a | 49 | 4 | 9 | B_3501 | SPGSAGIIL | 6634 | 20.000 |
| 297 | HCV 3a | 49 | 32 | 9 | B_3501 | RSQSSLQGL | 6635 | 10.000 |
| 298 | HCV 3a | 49 | 28 | 10 | B7 | SQMIrSQSSL | 6636 | 12.000 |
| 299 | HCV 3a | 50 | 123 | 9 | A1 | VTEAVNAIR | 6637 | 45.000 |
| 300 | HCV 3a | 50 | 104 | 9 | A1 | ATHPPSMLK | 6638 | 25.000 |
| 301 | HCV 3a | 50 | 47 | 9 | A1 | GSSPPMILK | 6639 | 15.000 |
| 302 | HCV 3a | 50 | 109 | 9 | A_0201 | SMLKNIVWL | 6640 | 722.126 |
| 303 | HCV 3a | 50 | 95 | 9 | A_0201 | ELWGPAKWV | 6641 | 238.129 |
| 304 | HCV 3a | 50 | 110 | 9 | A_0201 | MLKNIVWLV | 6642 | 71.386 |
| 305 | HCV 3a | 50 | 148 | 9 | A_0201 | WIPLTKFHI | 6643 | 38.273 |
| 306 | HCV 3a | 50 | 122 | 9 | A_0201 | LVTEAVNAI | 6644 | 14.634 |
| 307 | HCV 3a | 50 | 116 | 9 | A_0201 | WLVVRGLVT | 6645 | 14.054 |
| 308 | HCV 3a | 50 | 161 | 9 | A_0201 | KASSFCQLV | 6646 | 12.848 |
| 309 | HCV 3a | 50 | 19 | 9 | A_0201 | SMAAHITPT | 6647 | 12.379 |
| 310 | HCV 3a | 50 | 114 | 9 | A_0201 | IVWLVVRGL | 6648 | 12.132 |
| 311 | HCV 3a | 50 | 74 | 9 | A_0201 | TLPRPIPPM | 6649 | 11.426 |
| 312 | HCV 3a | 50 | 174 | 9 | A_0201 | SMTACCWVA | 6650 | 11.033 |
| 313 | HCV 3a | 50 | 188 | 9 | A_0201 | RTFSLNWWA | 6651 | 10.531 |
| 314 | HCV 3a | 50 | 146 | 9 | A24 | RYWIPLTKF | 6652 | 220.000 |
| 315 | HCV 3a | 50 | 129 | 9 | B7 | AIRDATAGL | 6653 | 120.000 |
| 316 | HCV 3a | 50 | 143 | 9 | B7 | RPARYWIPL | 6654 | 80.000 |
| 317 | HCV 3a | 50 | 62 | 9 | B7 | TPAPYPARM | 6655 | 20.000 |
| 318 | HCV 3a | 50 | 75 | 9 | B7 | LPRPIPPMA | 6656 | 20.000 |
| 319 | HCV 3a | 50 | 114 | 9 | B7 | IVWLVVRGL | 6657 | 20.000 |
| 320 | HCV 3a | 50 | 103 | 9 | B7 | VATHPPSML | 6658 | 18.000 |
| 321 | HCV 3a | 50 | 27 | 9 | B7 | TTRAPGDSM | 6659 | 15.000 |
| 322 | HCV 3a | 50 | 67 | 9 | B7 | PARMSSKTL | 6660 | 12.000 |

TABLE 4j-continued 3a (4-6)

| No. | Strain | ORF | Start | AA | HLA | Peptide sequence | SEQ ID NO: | Score |
|---|---|---|---|---|---|---|---|---|
| 323 | HCV 3a | 50 | 143 | 9 | B_3501 | RPARYWIPL | 6661 | 40.000 |
| 324 | HCV 3a | 50 | 62 | 9 | B_3501 | TPAPYPARM | 6662 | 40.000 |
| 325 | HCV 3a | 50 | 186 | 9 | B_3501 | NPRTFSLNW | 6663 | 30.000 |
| 326 | HCV 3a | 50 | 58 | 9 | B_3501 | KAPETPAPY | 6664 | 24.000 |
| 327 | HCV 3a | 50 | 94 | 9 | B_4403 | EELWGPAKW | 6665 | 36.000 |
| 328 | HCV 3a | 50 | 141 | 9 | B_4403 | VERPARYWI | 6666 | 12.000 |
| 329 | HCV 3a | 50 | 109 | 10 | A_0201 | SMLKnIVWLV | 6667 | 3.206.057 |
| 330 | HCV 3a | 50 | 157 | 10 | A_0201 | CLCQkASSFC | 6668 | 27.324 |
| 331 | HCV 3a | 50 | 121 | 10 | A_0201 | GLVTeAVNAI | 6669 | 23.995 |
| 332 | HCV 3a | 50 | 114 | 10 | A_0201 | IVWLvVRGLV | 6670 | 11.163 |
| 333 | HCV 3a | 50 | 87 | 10 | A24 | KPLTtNAEEL | 6671 | 13.200 |
| 334 | HCV 3a | 50 | 45 | 10 | B7 | AVGSsPPMIL | 6672 | 90.000 |
| 335 | HCV 3a | 50 | 66 | 10 | B7 | YPARmSSKTL | 6673 | 80.000 |
| 336 | HCV 3a | 50 | 87 | 10 | B7 | KPLTtNAEEL | 6674 | 80.000 |
| 337 | HCV 3a | 50 | 149 | 10 | B7 | IPLTkFHICL | 6675 | 80.000 |
| 338 | HCV 3a | 50 | 80 | 10 | B7 | PPMAaPAKPL | 6676 | 36.000 |
| 339 | HCV 3a | 50 | 75 | 10 | B7 | LPRPiPPMAA | 6677 | 30.000 |
| 340 | HCV 3a | 50 | 102 | 10 | B7 | WVAThPPSML | 6678 | 30.000 |
| 341 | HCV 3a | 50 | 11 | 10 | B7 | SPGPtCRRSM | 6679 | 30.000 |
| 342 | HCV 3a | 50 | 128 | 10 | B7 | NAIRdATAGL | 6680 | 12.000 |
| 343 | HCV 3a | 50 | 118 | 10 | B7 | VVRGlVTEAV | 6681 | 10.000 |
| 344 | HCV 3a | 50 | 11 | 10 | B_3501 | SPGPtCRRSM | 6682 | 40.000 |
| 345 | HCV 3a | 50 | 87 | 10 | B_3501 | KPLTtNAEEL | 6683 | 40.000 |
| 346 | HCV 3a | 50 | 186 | 10 | B_3501 | NPRTfSLNWW | 6684 | 30.000 |
| 347 | HCV 3a | 50 | 149 | 10 | B_3501 | IPLTkFHICL | 6685 | 20.000 |
| 348 | HCV 3a | 50 | 66 | 10 | B_3501 | YPARmSSKTL | 6686 | 20.000 |
| 349 | HCV 3a | 50 | 163 | 10 | B_3501 | SSFCqLVATM | 6687 | 10.000 |
| 350 | HCV 3a | 50 | 33 | 10 | B_3501 | DSMAgNRLTM | 6688 | 10.000 |
| 351 | HCV 3a | 50 | 43 | 10 | B_3501 | SSAVgSSPPM | 6689 | 10.000 |
| 352 | HCV 3a | 50 | 93 | 10 | B_4403 | AEELwGPAKW | 6690 | 36.000 |
| 353 | HCV 3a | 50 | 94 | 10 | B_4403 | EELWgPAKWV | 6691 | 18.000 |
| 354 | HCV 3a | 50 | 124 | 10 | B_4403 | TEAVnAIRDA | 6692 | 12.000 |
| 355 | HCV 3a | 51 | 6 | 9 | B_4403 | CEHSSISSY | 6693 | 120.000 |
| 356 | HCV 3a | 51 | 5 | 10 | A1 | ACEHsSISSY | 6694 | 45.000 |
| 357 | HCV 3a | 52 | 3 | 9 | A_0201 | AMTYFVMGC | 6695 | 31.359 |
| 358 | HCV 3a | 52 | 7 | 9 | A_0201 | FVMGCDKQI | 6696 | 15.537 |
| 359 | HCV 3a | 52 | 23 | 9 | A24 | RYKRGVGPC | 6697 | 10.000 |
| 360 | HCV 3a | 52 | 27 | 9 | B7 | GVGPCSVGL | 6698 | 20.000 |
| 361 | HCV 3a | 52 | 35 | 9 | B8 | LSRTRHFHV | 6699 | 12.000 |
| 362 | HCV 3a | 52 | 34 | 10 | A_0201 | GLSRtRHFHV | 6700 | 403.402 |
| 363 | HCV 3a | 52 | 23 | 10 | A24 | RYKRgVGPCS | 6701 | 14.000 |
| 364 | HCV 3a | 52 | 26 | 10 | A24 | RGVGpCSVGL | 6702 | 12.000 |
| 365 | HCV 3a | 52 | 15 | 10 | B_3501 | ISFWtGPNRY | 6703 | 10.000 |
| 366 | HCV 3a | 53 | 21 | 9 | A1 | MTESKSPVY | 6704 | 225.000 |
| 367 | HCV 3a | 53 | 20 | 9 | A_0201 | SMTESKSPV | 6705 | 205.951 |
| 368 | HCV 3a | 53 | 46 | 9 | A_0201 | GMTDTSRPL | 6706 | 12.651 |
| 369 | HCV 3a | 53 | 17 | 9 | A3 | TLQSMTESK | 6707 | 20.000 |
| 370 | HCV 3a | 53 | 13 | 9 | B_3501 | CSTATLQSM | 6708 | 10.000 |
| 371 | HCV 3a | 53 | 45 | 10 | B7 | VGMTdTSRPL | 6709 | 12.000 |
| 372 | HCV 3a | 53 | 23 | 10 | B_3501 | ESKSpVYPVM | 6710 | 30.000 |
| 373 | HCV 3a | 53 | 9 | 10 | B_3501 | KSTYcSTATL | 6711 | 10.000 |
| 374 | HCV 3a | 53 | 22 | 10 | B_4403 | TESKsPVYPV | 6712 | 12.000 |
| 375 | HCV 3a | 54 | 7 | 9 | A_0201 | VMLPGGVRV | 6713 | 315.959 |
| 376 | HCV 3a | 54 | 6 | 10 | A_0201 | TVMLpGGVRV | 6714 | 22.517 |
| 377 | HCV 3a | 54 | 8 | 10 | A3 | MLPGgVRVAK | 6715 | 45.000 |
| 378 | HCV 3a | 54 | 12 | 10 | B7 | GVRVaKTVSL | 6716 | 200.000 |
| 379 | HCV 3a | 54 | 12 | 10 | B8 | GVRVaKTVSL | 6717 | 80.000 |
| 380 | HCV 3a | 55 | 12 | 9 | B_4403 | DGFSTRTVY | 6718 | 13.500 |
| 381 | HCV 3a | 55 | 5 | 10 | B_3501 | KPSVaATDGF | 6719 | 40.000 |
| 382 | HCV 3a | 55 | 11 | 10 | B_4403 | TDGFsTRTVY | 6720 | 22.500 |
| 383 | HCV 3a | 55 | 2 | 10 | B_4403 | KEPKpSVAAT | 6721 | 12.000 |
| 384 | HCV 3a | 56 | 40 | 9 | A_0201 | GLGLSKLAV | 6722 | 69.552 |
| 385 | HCV 3a | 56 | 65 | 9 | A24 | KYKSAEPQA | 6723 | 10.000 |
| 386 | HCV 3a | 56 | 45 | 9 | A3 | KLAVESPLR | 6724 | 12.000 |
| 387 | HCV 3a | 56 | 33 | 9 | B7 | EPLRQARGL | 6725 | 80.000 |
| 388 | HCV 3a | 56 | 8 | 9 | B7 | TPLVHTAAL | 6726 | 80.000 |
| 389 | HCV 3a | 56 | 2 | 9 | B7 | NCRAFATPL | 6727 | 40.000 |
| 390 | HCV 3a | 56 | 2 | 9 | B8 | NCRAFATPL | 6728 | 16.000 |
| 391 | HCV 3a | 56 | 8 | 9 | B_3501 | TPLVHTAAL | 6729 | 20.000 |
| 392 | HCV 3a | 56 | 33 | 9 | B_3501 | EPLRQARGL | 6730 | 20.000 |
| 393 | HCV 3a | 56 | 58 | 9 | B_3501 | TSASRVTKY | 6731 | 10.000 |
| 394 | HCV 3a | 56 | 49 | 9 | B_3501 | ESPLRRAGM | 6732 | 10.000 |
| 395 | HCV 3a | 56 | 58 | 9 | B_4403 | TSASRVTKY | 6733 | 40.500 |
| 396 | HCV 3a | 56 | 68 | 10 | A1 | SAEPqAHGSR | 6734 | 90.000 |
| 397 | HCV 3a | 56 | 56 | 10 | A3 | GMTSaSRVTK | 6735 | 60.000 |

TABLE 4j-continued 3a (4-6)

| No. | Strain | ORF | Start | AA | HLA | Peptide sequence | SEQ ID NO: | Score |
|---|---|---|---|---|---|---|---|---|
| 398 | HCV 3a | 56 | 45 | 10 | A3 | KLAVeSPLRR | 6736 | 24.000 |
| 399 | HCV 3a | 56 | 37 | 10 | B7 | QARGlGLSKL | 6737 | 120.000 |
| 400 | HCV 3a | 56 | 70 | 10 | B7 | EPQAhGSRDL | 6738 | 80.000 |
| 401 | HCV 3a | 56 | 7 | 10 | B7 | ATPLvHTAAL | 6739 | 12.000 |
| 402 | HCV 3a | 56 | 18 | 10 | B7 | IPATcPEGHI | 6740 | 12.000 |
| 403 | HCV 3a | 56 | 37 | 10 | B8 | QARGLGLSKL | 6741 | 16.000 |
| 404 | HCV 3a | 56 | 34 | 10 | B8 | PLRQaRGLGL | 6742 | 16.000 |
| 405 | HCV 3a | 56 | 70 | 10 | B_3501 | EPQAhGSRDL | 6743 | 20.000 |
| 406 | HCV 3a | 56 | 43 | 10 | B_3501 | LSKLaVESPL | 6744 | 15.000 |
| 407 | HCV 3a | 56 | 57 | 10 | B_4403 | MTSAsRVTKY | 6745 | 20.250 |
| 408 | HCV 3a | 57 | 2 | 9 | A_0201 | TLISMGLNI | 6746 | 10.433 |
| 409 | HCV 3a | 57 | 21 | 9 | B_3501 | RPAAAQCCI | 6747 | 16.000 |
| 410 | HCV 3a | 57 | 27 | 9 | B_4403 | CCIGARWSY | 6748 | 33.750 |
| 411 | HCV 3a | 57 | 16 | 10 | B8 | TARSLRPAAA | 6749 | 16.000 |
| 412 | HCV 3a | 58 | 13 | 9 | A1 | ITERTSMQR | 6750 | 11.250 |
| 413 | HCV 3a | 58 | 5 | 9 | A_0201 | IIWKYFPPI | 6751 | 38.458 |
| 414 | HCV 3a | 58 | 1 | 9 | A3 | MLSMIIWKY | 6752 | 27.000 |
| 415 | HCV 3a | 58 | 5 | 10 | A_0201 | IIWKyFPPIT | 6753 | 22.525 |
| 416 | HCV 3a | 58 | 8 | 10 | A24 | KYFPpITERT | 6754 | 16.800 |
| 417 | HCV 3a | 58 | 10 | 10 | B7 | FPPItERTSM | 6755 | 30.000 |
| 418 | HCV 3a | 58 | 10 | 10 | B_3501 | FPPItERTSM | 6756 | 60.000 |
| 419 | HCV 3a | 59 | 52 | 9 | A24 | KTPAPRVAL | 6757 | 12.000 |
| 420 | HCV 3a | 59 | 38 | 9 | A3 | CLYQGDKVK | 6758 | 50.000 |
| 421 | HCV 3a | 59 | 31 | 9 | B7 | HIRRPIQCL | 6759 | 60.000 |
| 422 | HCV 3a | 59 | 6 | 9 | B7 | LPRASKGGT | 6760 | 20.000 |
| 423 | HCV 3a | 59 | 47 | 9 | B_3501 | KPKRAKTPA | 6761 | 12.000 |
| 424 | HCV 3a | 59 | 19 | 9 | B_4403 | ADSHLHMVY | 6762 | 30.000 |
| 425 | HCV 3a | 59 | 18 | 10 | A1 | RADShLHMVY | 6763 | 125.000 |
| 426 | HCV 3a | 59 | 59 | 10 | A_0201 | ALSSpDHAYA | 6764 | 27.324 |
| 427 | HCV 3a | 59 | 38 | 10 | A3 | CLYQgDKVKK | 6765 | 100.000 |
| 428 | HCV 3a | 59 | 24 | 10 | A3 | HMVYwFHHIR | 6766 | 18.000 |
| 429 | HCV 3a | 59 | 77 | 10 | B7 | KARGqRPVRL | 6767 | 120.000 |
| 430 | HCV 3a | 59 | 77 | 10 | B8 | KARGqRPVRL | 6768 | 160.000 |
| 431 | HCV 3a | 59 | 77 | 10 | B_3501 | KARGqRPVRL | 6769 | 18.000 |
| 432 | HCV 3a | 60 | 2 | 9 | A_0201 | RMTNSHFSA | 6770 | 20.810 |
| 433 | HCV 3a | 60 | 5 | 10 | B_3501 | NSHFsAHPTM | 6771 | 10.000 |
| 434 | HCV 3a | 61 | 68 | 9 | A_0201 | TLNNVKLTV | 6772 | 69.552 |
| 435 | HCV 3a | 61 | 66 | 9 | A_0201 | ILTLNNVKL | 6773 | 36.316 |
| 436 | HCV 3a | 61 | 51 | 9 | A_0201 | QLQAAVNRC | 6774 | 11.426 |
| 437 | HCV 3a | 61 | 61 | 9 | B7 | NPPTNILTL | 6775 | 80.000 |
| 438 | HCV 3a | 61 | 44 | 9 | B7 | SQRSPLVQL | 6776 | 60.000 |
| 439 | HCV 3a | 61 | 61 | 9 | B_3501 | NPPTNILTL | 6777 | 20.000 |
| 440 | HCV 3a | 61 | 66 | 10 | A_0201 | ILTLnNVKLT | 6778 | 29.137 |
| 441 | HCV 3a | 61 | 65 | 10 | A_0201 | NILTINNVKL | 6779 | 10.868 |
| 442 | HCV 3a | 61 | 6 | 10 | B7 | CIRPvDSAGM | 6780 | 10.000 |
| 443 | HCV 3a | 61 | 8 | 10 | B_3501 | RPVDsAGMGV | 6781 | 16.000 |
| 444 | HCV 3a | 61 | 40 | 10 | B_3501 | RSSIsQRSPL | 6782 | 10.000 |
| 445 | HCV 3a | 62 | 14 | 9 | A24 | LYVASGCFL | 6783 | 300.000 |
| 446 | HCV 3a | 62 | 21 | 9 | A3 | FLKQSVGQK | 6784 | 18.000 |
| 447 | HCV 3a | 62 | 13 | 10 | A_0201 | RLYVaSGCFL | 6785 | 375.978 |
| 448 | HCV 3a | 63 | 9 | 9 | A_0201 | VLTNPVEFI | 6786 | 109.935 |
| 449 | HCV 3a | 63 | 6 | 9 | B7 | APHVLTNPV | 6787 | 12.000 |
| 450 | HCV 3a | 63 | 32 | 9 | B_3501 | SSRNTSVSF | 6788 | 15.000 |
| 451 | HCV 3a | 63 | 4 | 9 | B_4403 | GEAPHVLTN | 6789 | 14.400 |
| 452 | HCV 3a | 64 | 15 | 9 | A_0201 | VMGLQLLSL | 6790 | 60.325 |
| 453 | HCV 3a | 64 | 4 | 9 | B7 | SVKGPHPCL | 6791 | 30.000 |
| 454 | HCV 3a | 64 | 14 | 10 | A_0201 | KVMGLQLLSL | 6792 | 55.674 |
| 455 | HCV 3a | 64 | 14 | 10 | A24 | KVMGLQLLSL | 6793 | 12.000 |
| 456 | HCV 3a | 64 | 9 | 10 | B7 | HPCLkKVMGL | 6794 | 80.000 |
| 457 | HCV 3a | 64 | 14 | 10 | B7 | KVMGlQLLSL | 6795 | 60.000 |
| 458 | HCV 3a | 64 | 7 | 10 | B7 | GPHPcLKKVM | 6796 | 20.000 |
| 459 | HCV 3a | 64 | 3 | 10 | B7 | ASVKgPHPCL | 6797 | 18.000 |
| 460 | HCV 3a | 64 | 9 | 10 | B8 | HPCLkKVMGL | 6798 | 16.000 |
| 461 | HCV 3a | 64 | 7 | 10 | B_3501 | GPHPcLKKVM | 6799 | 40.000 |
| 462 | HCV 3a | 64 | 9 | 10 | B_3501 | HPCLkKVMGL | 6800 | 20.000 |
| 463 | HCV 3a | 65 | 15 | 9 | A_0201 | LLMCHEPLV | 6801 | 437.482 |
| 464 | HCV 3a | 65 | 14 | 9 | A_0201 | VLLMCHEPL | 6802 | 65.841 |
| 465 | HCV 3a | 65 | 5 | 9 | A_0201 | FMDSLQFRA | 6803 | 38.291 |
| 466 | HCV 3a | 65 | 8 | 9 | A_0201 | SLQFRAVLL | 6804 | 21.362 |
| 467 | HCV 3a | 65 | 22 | 9 | A_0201 | LVLTSCSFC | 6805 | 15.038 |
| 468 | HCV 3a | 65 | 16 | 9 | A_0201 | LMCHEPLVL | 6806 | 10.754 |
| 469 | HCV 3a | 65 | 19 | 9 | B_4403 | HEPLVLTSC | 6807 | 13.500 |
| 470 | HCV 3a | 65 | 14 | 10 | A_0201 | VLLMcHEPLV | 6808 | 437.482 |
| 471 | HCV 3a | 65 | 23 | 10 | A_0201 | VLTScSFCWA | 6809 | 88.257 |
| 472 | HCV 3a | 65 | 15 | 10 | A_0201 | LLMChEPLVL | 6810 | 55.091 |

TABLE 4j-continued

| | | | | 3a (4-6) | | | |
|---|---|---|---|---|---|---|---|
| No. Strain | ORF | Start | AA | HLA | Peptide sequence | SEQ ID NO: | Score |
| 473 HCV 3a | 65 | 5 | 10 | A_0201 | FMDSlQFRAV | 6811 | 35.122 |
| 474 HCV 3a | 65 | 16 | 10 | A_0201 | LMCHePLVLT | 6812 | 21.044 |
| 475 HCV 3a | 65 | 29 | 10 | A_0201 | FCWApTLKRL | 6813 | 12.246 |
| 476 HCV 3a | 65 | 8 | 10 | A_0201 | SLQFrAVLLM | 6814 | 11.426 |
| 477 HCV 3a | 65 | 13 | 10 | B7 | AVLLmCHEPL | 6815 | 60.000 |
| 478 HCV 3a | 65 | 15 | 10 | B7 | LLMChEPLVL | 6816 | 12.000 |
| 479 HCV 3a | 65 | 2 | 10 | B_3501 | NPVFmDSLQF | 6817 | 30.000 |
| 480 HCV 3a | 65 | 20 | 10 | B_3501 | EPLVLTSCSF | 6818 | 20.000 |
| 481 HCV 3a | 66 | 1 | 9 | A_0201 | MMIATLAQL | 6819 | 60.325 |
| 482 HCV 3a | 67 | 8 | 9 | A_0201 | IMSNKVWGT | 6820 | 157.827 |
| 483 HCV 3a | 67 | 48 | 9 | A_0201 | SEQLQVWTV | 6821 | 23.329 |
| 484 HCV 3a | 67 | 30 | 9 | A24 | QFIIISQAI | 6822 | 12.600 |
| 485 HCV 3a | 67 | 43 | 9 | A24 | RWPGYSEQL | 6823 | 12.000 |
| 486 HCV 3a | 67 | 24 | 9 | B7 | IPRAGNQFI | 6824 | 80.000 |
| 487 HCV 3a | 67 | 1 | 9 | B7 | MPQWAPAIM | 6825 | 20.000 |
| 488 HCV 3a | 67 | 5 | 9 | B7 | APAIMSNKV | 6826 | 12.000 |
| 489 HCV 3a | 67 | 1 | 9 | B_3501 | MPQWAPAIM | 6827 | 40.000 |
| 490 HCV 3a | 67 | 24 | 9 | B_3501 | IPRAGNQFI | 6828 | 24.000 |
| 491 HCV 3a | 67 | 48 | 9 | B_4403 | SEQLQVWTV | 6829 | 24.000 |
| 492 HCV 3a | 67 | 7 | 10 | A_0201 | AIMSnKVWGT | 6830 | 65.398 |
| 493 HCV 3a | 67 | 55 | 10 | A_0201 | TVWWrRGLNV | 6831 | 50.512 |
| 494 HCV 3a | 67 | 12 | 10 | A_0201 | KVWGtRRTCA | 6832 | 12.628 |
| 495 HCV 3a | 67 | 50 | 10 | A3 | QLQVwTVWWR | 6833 | 36.000 |
| 496 HCV 3a | 67 | 61 | 10 | A3 | GLNVkACPTR | 6834 | 12.000 |
| 497 HCV 3a | 67 | 24 | 10 | B7 | IPRAgNQFII | 6835 | 80.000 |
| 498 HCV 3a | 67 | 24 | 10 | B_3501 | IPRAgNQFII | 6836 | 24.000 |
| 499 HCV 3a | 67 | 5 | 10 | B_3501 | APAImSNKVW | 6837 | 10.000 |
| 500 HCV 3a | 67 | 48 | 10 | B_4403 | SEQLqVWTVW | 6838 | 54.000 |
| 501 HCV 3a | 67 | 22 | 10 | B_4403 | TAIPrAGNQF | 6839 | 15.000 |
| 502 HCV 3a | 68 | 9 | 9 | A_0201 | ILLLEQSLV | 6840 | 437.482 |
| 503 HCV 3a | 68 | 8 | 9 | A_0201 | TILLLEQSL | 6841 | 10.868 |
| 504 HCV 3a | 68 | 10 | 9 | A3 | LLLEQSLVR | 6842 | 18.000 |
| 505 HCV 3a | 68 | 4 | 9 | B7 | SASYTILLL | 6843 | 12.000 |
| 506 HCV 3a | 68 | 10 | 10 | A_0201 | LLLEqSLVRT | 6844 | 442.013 |
| 507 HCV 3a | 68 | 8 | 10 | A_0201 | TILLLEQSLV | 6845 | 35.385 |
| 508 HCV 3a | 68 | 9 | 10 | A3 | ILLLeQSLVR | 6846 | 12.000 |
| 509 HCV 3a | 69 | 42 | 9 | B7 | HPAHPQPSL | 6847 | 120.000 |
| 510 HCV 3a | 69 | 12 | 9 | B7 | RVSMTLPKL | 6848 | 20.000 |
| 511 HCV 3a | 69 | 42 | 9 | B_3501 | HPAHPQPSL | 6849 | 20.000 |
| 512 HCV 3a | 69 | 8 | 10 | B7 | NPHVrVSMTL | 6850 | 80.000 |
| 513 HCV 3a | 69 | 35 | 10 | B7 | EPRGdRSHPA | 6851 | 20.000 |
| 514 HCV 3a | 69 | 2 | 10 | B7 | YPMRsANPHV | 6852 | 12.000 |
| 515 HCV 3a | 69 | 35 | 10 | B8 | EPRGdRSHPA | 6853 | 32.000 |
| 516 HCV 3a | 69 | 8 | 10 | B_3501 | NPHVrVSMTL | 6854 | 20.000 |
| 517 HCV 3a | 69 | 19 | 10 | B_3501 | KLRDLRRGSF | 6855 | 12.000 |
| 518 HCV 3a | 70 | 3 | 9 | A_0201 | FLLVFLCGL | 6856 | 3.177.760 |
| 519 HCV 3a | 70 | 15 | 9 | A_0201 | LMLHGLRDL | 6857 | 44.641 |
| 520 HCV 3a | 70 | 7 | 9 | A_0201 | FLCGLGSVL | 6858 | 40.289 |
| 521 HCV 3a | 70 | 1 | 9 | A_0201 | MVFLLVFLC | 6859 | 36.475 |
| 522 HCV 3a | 70 | 30 | 9 | A24 | PYQAVPQGL | 6860 | 50.400 |
| 523 HCV 3a | 70 | 37 | 9 | A3 | GLSRPNTTR | 6861 | 18.000 |
| 524 HCV 3a | 70 | 38 | 9 | B7 | LSRPNTTRL | 6862 | 40.000 |
| 525 HCV 3a | 70 | 40 | 9 | B7 | RPNTTRLVI | 6863 | 12.000 |
| 526 HCV 3a | 70 | 23 | 9 | B_3501 | LPGHSQAPY | 6864 | 40.000 |
| 527 HCV 3a | 70 | 40 | 9 | B_3501 | RPNTTRLVI | 6865 | 16.000 |
| 528 HCV 3a | 70 | 38 | 9 | B_3501 | LSRPNTTRL | 6866 | 15.000 |
| 529 HCV 3a | 70 | 14 | 10 | A_0201 | VLMLhGLRDL | 6867 | 61.810 |
| 530 HCV 3a | 70 | 7 | 10 | A_0201 | FLCGLGSVLM | 6868 | 22.853 |
| 531 HCV 3a | 70 | 37 | 10 | A_0201 | GLSRpNTTRL | 6869 | 21.362 |
| 532 HCV 3a | 70 | 5 | 10 | A_0201 | LVFLcGLGSV | 6870 | 11.446 |
| 533 HCV 3a | 70 | 6 | 10 | A24 | VFLCgLGSVL | 6871 | 36.000 |
| 534 HCV 3a | 70 | 2 | 10 | A24 | VFLLvFLCGL | 6872 | 30.000 |
| 535 HCV 3a | 70 | 29 | 10 | B7 | APYQaVPQGL | 6873 | 240.000 |
| 536 HCV 3a | 70 | 14 | 10 | B7 | VLMLhGLRDL | 6874 | 12.000 |
| 537 HCV 3a | 70 | 29 | 10 | B_3501 | APYQaVPQGL | 6875 | 20.000 |

TABLE 4k

3b (1-3)

| No. | Strain | ORF | Start | AA | HLA | Peptide sequence | SEQ ID NO: | Score |
|---|---|---|---|---|---|---|---|---|
| 1 | HCV 3b | 1 | 2 | 9 | A_0201 | ALVRVSCSL | 6876 | 21.36 |
| 2 | HCV 3b | 1 | 1 | 10 | B7 | MALVRVSCSL | 6877 | 12 |
| 3 | HCV 3b | 1 | 2 | 9 | B7 | ALVRVSCSL | 6878 | 12 |
| 4 | HCV 3b | 2 | 79 | 9 | A1 | GVDPATWVR | 6879 | 50 |
| 5 | HCV 3b | 2 | 79 | 10 | A1 | GVDPaTWVRS | 6880 | 10 |
| 6 | HCV 3b | 2 | 24 | 10 | A1 | LADGvSLPPR | 6881 | 10 |
| 7 | HCV 3b | 2 | 75 | 9 | A_0201 | KMTPGVDPA | 6882 | 14.15 |
| 8 | HCV 3b | 2 | 75 | 10 | A_0201 | KMTPgVDPAT | 6883 | 18.84 |
| 9 | HCV 3b | 2 | 68 | 10 | A_0201 | VLAPaGAKMT | 6884 | 12.67 |
| 10 | HCV 3b | 2 | 40 | 9 | B7 | GPGPSPGTL | 6885 | 80 |
| 11 | HCV 3b | 2 | 10 | 9 | B7 | WVCAKQVRL | 6886 | 20 |
| 12 | HCV 3b | 2 | 15 | 10 | B7 | QVRLpSDHNL | 6887 | 200 |
| 13 | HCV 3b | 2 | 40 | 9 | B_3501 | GPGPSPGTL | 6888 | 20 |
| 14 | HCV 3b | 2 | 77 | 9 | B_3501 | TPGVDPATW | 6889 | 15 |
| 15 | HCV 3b | 3 | 2 | 10 | A_0201 | RLAYiCLPTT | 6890 | 17.14 |
| 16 | HCV 3b | 3 | 8 | 10 | B7 | LPTTaPTGAL | 6891 | 120 |
| 17 | HCV 3b | 3 | 8 | 10 | B_3501 | LPTTaPTGAL | 6892 | 20 |
| 18 | HCV 3b | 4 | | | | no hits | | |
| 19 | HCV 3b | 5 | | | | no hits | | |
| 20 | HCV 3b | 6 | | | | no hits | | |
| 21 | HCV 3b | 7 | 8 | 10 | A_0201 | ALHPhRWWWA | 6893 | 348.38 |
| 22 | HCV 3b | 7 | 17 | 10 | B7 | APLIIKACQL | 6894 | 240 |
| 23 | HCV 3b | 7 | 10 | 10 | B7 | HPHRwWWAPL | 6895 | 80 |
| 24 | HCV 3b | 7 | 10 | 10 | B_3501 | HPHRwWWAPL | 6896 | 20 |
| 25 | HCV 3b | 7 | 17 | 10 | B_3501 | APLILKACQL | 6897 | 20 |
| 26 | HCV 3b | 8 | 5 | 10 | B7 | LPAAgPGPGL | 6898 | 120 |
| 27 | HCV 3b | 8 | 11 | 9 | B_3501 | GPGLRQGVW | 6899 | 10 |
| 28 | HCV 3b | 9 | 12 | 9 | A1 | RGESAVILK | 6900 | 22.5 |
| 29 | HCV 3b | 9 | 17 | 9 | A_0201 | VILKIVTAV | 6901 | 138.35 |
| 30 | HCV 3b | 9 | 16 | 10 | A_0201 | AVILKIVTAV | 6902 | 14 |
| 31 | HCV 3b | 9 | 10 | 10 | B7 | TGRGESAVIL | 6903 | 40 |
| 32 | HCV 3b | 10 | 50 | 9 | A_0201 | CLFEVVGTV | 6904 | 315.48 |
| 33 | HCV 3b | 10 | 45 | 10 | A_0201 | YGSPPCLFEV | 6905 | 27.86 |
| 34 | HCV 3b | 10 | 44 | 9 | A24 | KYGSPPCLF | 6906 | 200 |
| 35 | HCV 3b | 10 | 16 | 10 | A24 | PYHHGISTGL | 6907 | 28 |
| 36 | HCV 3b | 10 | 27 | 10 | A3 | VLSGGTSMPY | 6908 | 12 |
| 37 | HCV 3b | 10 | 26 | 9 | B7 | AVLSGGTSM | 6909 | 15 |
| 38 | HCV 3b | 10 | 28 | 10 | B_3501 | LSGGTSMPY | 6910 | 10 |
| 39 | HCV 3b | 10 | 8 | 10 | B_3501 | CSCSsGSLPY | 6911 | 10 |
| 40 | HCV 3b | 10 | 37 | 9 | B_4403 | AGVRPPCKY | 6912 | 18 |
| 41 | HCV 3b | 11 | 86 | 9 | A_0201 | KLGDYLELL | 6913 | 345.48 |
| 42 | HCV 3b | 11 | 26 | 9 | A_0201 | SLVLWRLRL | 6914 | 21.36 |
| 43 | HCV 3b | 11 | 55 | 10 | A_0201 | RGWAASCCWV | 6915 | 20.73 |
| 44 | HCV 3b | 11 | 79 | 9 | A24 | RSQHTPSKL | 6916 | 13.2 |
| 45 | HCV 3b | 11 | 19 | 9 | A24 | RWPRSPSSL | 6917 | 12 |
| 46 | HCV 3b | 11 | 89 | 9 | A24 | DYLELLSPA | 6918 | 10.8 |
| 47 | HCV 3b | 11 | 10 | 10 | A3 | GLPRVSKDWR | 6919 | 12 |
| 48 | HCV 3b | 11 | 83 | 9 | B7 | TPSKLGDYL | 6920 | 80 |
| 49 | HCV 3b | 11 | 20 | 9 | B7 | WPRSPSSLV | 6921 | 60 |
| 50 | HCV 3b | 11 | 58 | 9 | B7 | AASCCWVRL | 6922 | 36 |
| 51 | HCV 3b | 11 | 20 | 10 | B7 | WPRSPSSLVL | 6923 | 800 |
| 52 | HCV 3b | 11 | 23 | 10 | B7 | SPSSLVLWRL | 6924 | 80 |
| 53 | HCV 3b | 11 | 57 | 10 | B7 | WAASCCWVRL | 6925 | 12 |
| 54 | HCV 3b | 11 | 20 | 10 | B8 | WPRSPSSLVL | 6926 | 16 |
| 55 | HCV 3b | 11 | 83 | 9 | B_3501 | TPSKLGDYL | 6927 | 20 |
| 56 | HCV 3b | 11 | 20 | 9 | B_3501 | WPRSPSSLV | 6928 | 12 |
| 57 | HCV 3b | 11 | 79 | 9 | B_3501 | RSQHTPSKL | 6929 | 10 |
| 58 | HCV 3b | 11 | 20 | 10 | B_3501 | WPRSPSSLVL | 6930 | 60 |
| 59 | HCV 3b | 11 | 11 | 10 | B_3501 | LPRVSKDWRW | 6931 | 30 |
| 60 | HCV 3b | 11 | 23 | 10 | B_3501 | SPSSLVLWRL | 6932 | 20 |
| 61 | HCV 3b | 11 | 44 | 10 | B_4403 | AETSCAGCPF | 6933 | 120 |
| 62 | HCV 3b | 12 | 2 | 9 | A_0201 | VLGRGLLLV | 6934 | 271.95 |
| 63 | HCV 3b | 12 | 1 | 9 | A_0201 | MVLGRGLLL | 6935 | 11.76 |
| 64 | HCV 3b | 12 | 1 | 10 | A_0201 | MVLGRGLLLV | 6936 | 88.04 |
| 65 | HCV 3b | 12 | 2 | 10 | A_0201 | VLGRGLLLVT | 6937 | 11.95 |
| 66 | HCV 3b | 12 | 13 | 9 | B7 | GPRFKCTPM | 6938 | 200 |
| 67 | HCV 3b | 12 | 1 | 9 | B7 | MVLGRGLLL | 6939 | 20 |
| 68 | HCV 3b | 12 | 13 | 9 | B8 | GPRFKCTPM | 6940 | 80 |
| 69 | HCV 3b | 12 | 13 | 9 | B_3501 | GPRFKCTPM | 6941 | 120 |
| 70 | HCV 3b | 12 | 13 | 10 | B_3501 | GPRFKCTPMW | 6942 | 30 |
| 71 | HCV 3b | 13 | | | | no hits | | |
| 72 | HCV 3b | 14 | 22 | 10 | B7 | TPHTaSSSPM | 6943 | 20 |
| 73 | HCV 3b | 14 | 26 | 10 | B7 | ASSSpMGVVL | 6944 | 12 |
| 74 | HCV 3b | 14 | 22 | 10 | B_3501 | TPHTaSSSPM | 6945 | 40 |
| 75 | HCV 3b | 15 | | | | no hits | | |

TABLE 4k-continued 3b (1-3)

| No. | Strain | ORF | Start | AA | HLA | Peptide sequence | SEQ ID NO: | Score |
|---|---|---|---|---|---|---|---|---|
| 76 | HCV 3b | 16 | | | | no hits | | |
| 77 | HCV 3b | 17 | 5 | 9 | B7 | VPGMTYNLL | 6946 | 80 |
| 78 | HCV 3b | 17 | 4 | 9 | B7 | VVPGMTYNL | 6947 | 20 |
| 79 | HCV 3b | 17 | 4 | 10 | B7 | VVPGMTYNLL | 6948 | 20 |
| 80 | HCV 3b | 17 | 3 | 10 | B7 | QVVPGMTYNL | 6949 | 20 |
| 81 | HCV 3b | 17 | 5 | 9 | B_3501 | VPGMTYNLL | 6950 | 20 |
| 82 | HCV 3b | 18 | | | | no hits | | |
| 83 | HCV 3b | 19 | | | | no hits | | |
| 84 | HCV 3b | 20 | 11 | 9 | A_0201 | LLTSSKHRL | 6951 | 36.32 |
| 85 | HCV 3b | 20 | 10 | 10 | A_0201 | LLLTSSKHRL | 6952 | 134.37 |
| 86 | HCV 3b | 20 | 3 | 9 | A24 | RWKNVPSLL | 6953 | 11.2 |
| 87 | HCV 3b | 20 | 1 | 10 | B7 | MMRWKNVPSL | 6954 | 40 |
| 88 | HCV 3b | 20 | 31 | 10 | B8 | CCKGRANKKL | 6955 | 16 |
| 89 | HCV 3b | 21 | | | | no hits | | |
| 90 | HCV 3b | 22 | | | | no hits | | |
| 91 | HCV 3b | 23 | 26 | 9 | A_0201 | CQAYPFSHV | 6956 | 13.4 |
| 92 | HCV 3b | 23 | 9 | 10 | A24 | SYLVtLRPGF | 6957 | 180 |
| 93 | HCV 3b | 23 | 37 | 9 | B7 | GTREYGEGM | 6958 | 10 |
| 94 | HCV 3b | 23 | 19 | 10 | B7 | RPRScPRCQA | 6959 | 45 |
| 95 | HCV 3b | 23 | 23 | 9 | B_3501 | CPRCQAYPF | 6960 | 60 |
| 96 | HCV 3b | 23 | 21 | 9 | B_3501 | RSCPRCQAY | 6961 | 20 |
| 97 | HCV 3b | 23 | 37 | 9 | B_3501 | GTREYGEGM | 6962 | 12 |
| 98 | HCV 3b | 23 | 2 | 9 | B_3501 | TSGTGSVSY | 6963 | 10 |
| 99 | HCV 3b | 24 | 6 | 9 | A_0201 | SMNTPLGRV | 6964 | 15.02 |
| 100 | HCV 3b | 24 | 2 | 10 | B7 | APSPSMNTPL | 6965 | 240 |
| 101 | HCV 3b | 24 | 17 | 10 | B7 | SPRTITRVPC | 6966 | 30 |
| 102 | HCV 3b | 24 | 2 | 10 | B_3501 | APSPSMNTPL | 6967 | 20 |
| 103 | HCV 3b | 25 | 9 | 10 | A_0201 | ILITWWGPRT | 6968 | 12.67 |
| 104 | HCV 3b | 25 | 1 | 10 | B7 | MSRCVGWGIL | 6969 | 40 |
| 105 | HCV 3b | 25 | 1 | 10 | B_3501 | MSRCvGWGIL | 6970 | 15 |
| 106 | HCV 3b | 26 | | | | no hits | | |
| 107 | HCV 3b | 27 | 1 | 9 | A_0201 | MQMGPSFHA | 6971 | 18.38 |
| 108 | HCV 3b | 28 | 1 | 10 | B7 | MGRMcPRHSL | 6972 | 90 |
| 109 | HCV 3b | 29 | 1 | 9 | A_0201 | MLTLGPPSV | 6973 | 118.24 |
| 110 | HCV 3b | 29 | 18 | 9 | B7 | AVLCHTPGL | 6974 | 60 |
| 111 | HCV 3b | 29 | 12 | 9 | B7 | KSRAWFAVL | 6975 | 40 |
| 112 | HCV 3b | 29 | 17 | 10 | B7 | FAVLCHTPGL | 6976 | 12 |
| 113 | HCV 3b | 29 | 10 | 9 | B8 | TPKSRAWFA | 6977 | 16 |
| 114 | HCV 3b | 29 | 12 | 9 | B_3501 | KSRAWFAVL | 6978 | 30 |
| 115 | HCV 3b | 29 | 10 | 10 | B_3501 | TPKSRAWFAV | 6979 | 12 |
| 116 | HCV 3b | 30 | | | | no hits | | |
| 117 | HCV 3b | 31 | | | | no hits | | |
| 118 | HCV 3b | 32 | 50 | 10 | A_0201 | ALAAsCLPAL | 6980 | 49.13 |
| 119 | HCV 3b | 32 | 48 | 9 | B7 | AAALAASCL | 6981 | 36 |
| 120 | HCV 3b | 32 | 11 | 9 | B7 | NVVTLNQRL | 6982 | 20 |
| 121 | HCV 3b | 32 | 51 | 9 | B7 | LAASCLPAL | 6983 | 12 |
| 122 | HCV 3b | 32 | 43 | 9 | B7 | NAVIAAAAL | 6984 | 12 |
| 123 | HCV 3b | 32 | 16 | 10 | B7 | NQRLgRQSAL | 6985 | 40 |
| 124 | HCV 3b | 32 | 47 | 10 | B7 | AAAALAASCL | 6986 | 36 |
| 125 | HCV 3b | 32 | 50 | 10 | B7 | ALAASCLPAL | 6987 | 12 |
| 126 | HCV 3b | 32 | 16 | 10 | B8 | NQRLGRQSAL | 6988 | 24 |
| 127 | HCV 3b | 33 | | | | no hits | | |
| 128 | HCV 3b | 34 | 8 | 9 | B7 | TTRSMPGNL | 6989 | 40 |
| 129 | HCV 3b | 34 | 3 | 10 | B_3501 | GSFLGTTRSM | 6990 | 10 |
| 130 | HCV 3b | 35 | 4 | 9 | B7 | APPRFSPQL | 6991 | 240 |
| 131 | HCV 3b | 35 | 3 | 10 | B7 | LAPPRFSPQL | 6992 | 12 |
| 132 | HCV 3b | 35 | 4 | 9 | B_3501 | APPRFSPQL | 6993 | 20 |
| 133 | HCV 3b | 36 | 32 | 9 | A1 | RVDPKSCEY | 6994 | 250 |
| 134 | HCV 3b | 36 | 40 | 9 | A_0201 | YVGGPANAV | 6995 | 28 |
| 135 | HCV 3b | 36 | 60 | 10 | A24 | RVPCgTSVHL | 6996 | 12 |
| 136 | HCV 3b | 36 | 61 | 9 | B7 | VPCGTSVHL | 6997 | 80 |
| 137 | HCV 3b | 36 | 6 | 10 | B7 | RNRQQQHIVL | 6998 | 40 |
| 138 | HCV 3b | 36 | 40 | 10 | B7 | YVGGPANAVL | 6999 | 20 |
| 139 | HCV 3b | 36 | 60 | 10 | B7 | RVPCGTSVHL | 7000 | 20 |
| 140 | HCV 3b | 36 | 61 | 9 | B_3501 | VPCGTSVHL | 7001 | 20 |
| 141 | HCV 3b | 37 | 2 | 10 | A1 | CVDEqYRVCK | 7002 | 20 |
| 142 | HCV 3b | 37 | 12 | 10 | A_0201 | DLWGsPLQHL | 7003 | 30.59 |
| 143 | HCV 3b | 37 | 9 | 10 | B8 | VCKDlWGSPL | 7004 | 24 |
| 144 | HCV 3b | 37 | 4 | 10 | B_4403 | DEQYrVCKDL | 7005 | 27 |
| 145 | HCV 3b | 38 | | | | no hits | | |
| 146 | HCV 3b | 39 | 108 | 9 | A1 | SADNLWFDR | 7006 | 25 |
| 147 | HCV 3b | 39 | 2 | 9 | A_0201 | LIYTYAPPV | 7007 | 52.03 |
| 148 | HCV 3b | 39 | 151 | 9 | A_0201 | RVLYLITMV | 7008 | 51.79 |
| 149 | HCV 3b | 39 | 111 | 9 | A_0201 | NLWFDRPVA | 7009 | 16.91 |
| 150 | HCV 3b | 39 | 1 | 10 | A_0201 | MLIYtYAPPV | 7010 | 118.24 |

TABLE 4k-continued

3b (1-3)

| No. | Strain | ORF | Start | AA | HLA | Peptide sequence | SEQ ID NO: | Score |
|---|---|---|---|---|---|---|---|---|
| 151 | HCV 3b | 39 | 124 | 9 | A24 | RPPAPSACL | 7011 | 12 |
| 152 | HCV 3b | 39 | 80 | 10 | A24 | RPQRsGTTGL | 7012 | 12 |
| 153 | HCV 3b | 39 | 90 | 9 | A3 | RLVPGCILR | 7013 | 18 |
| 154 | HCV 3b | 39 | 35 | 9 | A3 | GLGSQVGVR | 7014 | 10.8 |
| 155 | HCV 3b | 39 | 90 | 10 | A3 | RLVPgCILRR | 7015 | 27 |
| 156 | HCV 3b | 39 | 35 | 10 | A3 | GLGSqVGVRR | 7016 | 18 |
| 157 | HCV 3b | 39 | 147 | 9 | B7 | APAPRVLYL | 7017 | 240 |
| 158 | HCV 3b | 39 | 124 | 9 | B7 | RPPAPSACL | 7018 | 120 |
| 159 | HCV 3b | 39 | 149 | 9 | B7 | APRVLYLIT | 7019 | 60 |
| 160 | HCV 3b | 39 | 39 | 9 | B7 | QVGVRRPRL | 7020 | 30 |
| 161 | HCV 3b | 39 | 92 | 9 | B7 | VPGCILRRM | 7021 | 20 |
| 162 | HCV 3b | 39 | 149 | 10 | B7 | APRVlYLITM | 7022 | 600 |
| 163 | HCV 3b | 39 | 80 | 10 | B7 | RPQRsGTTGL | 7023 | 80 |
| 164 | HCV 3b | 39 | 88 | 10 | B7 | GLRLvPGCIL | 7024 | 60 |
| 165 | HCV 3b | 39 | 51 | 10 | B7 | GGRTrVCGPL | 7025 | 40 |
| 166 | HCV 3b | 39 | 147 | 10 | B7 | APAPrVLYLI | 7026 | 24 |
| 167 | HCV 3b | 39 | 146 | 10 | B7 | GAPApRVLYL | 7027 | 12 |
| 168 | HCV 3b | 39 | 147 | 9 | B8 | APAPRVLYL | 7028 | 16 |
| 169 | HCV 3b | 39 | 19 | 9 | B8 | EHRGRAIPL | 7029 | 16 |
| 170 | HCV 3b | 39 | 146 | 10 | B8 | GAPApRVLYL | 7030 | 16 |
| 171 | HCV 3b | 39 | 58 | 9 | B_3501 | GPLDDVTDF | 7031 | 60 |
| 172 | HCV 3b | 39 | 92 | 9 | B_3501 | VPGCILRRM | 7032 | 40 |
| 173 | HCV 3b | 39 | 124 | 9 | B_3501 | RPPAPSACL | 7033 | 40 |
| 174 | HCV 3b | 39 | 147 | 9 | B_3501 | APAPRVLYL | 7034 | 20 |
| 175 | HCV 3b | 39 | 83 | 9 | B_3501 | RSGTTGLRL | 7035 | 10 |
| 176 | HCV 3b | 39 | 149 | 10 | B_3501 | APRVLYLITM | 7036 | 120 |
| 177 | HCV 3b | 39 | 80 | 10 | B_3501 | RPQRsGTTGL | 7037 | 40 |
| 178 | HCV 3b | 39 | 105 | 10 | B_3501 | EARSaDNLWF | 7038 | 13.5 |
| 179 | HCV 3b | 39 | 78 | 9 | B_4403 | AERPQRSGT | 7039 | 16 |
| 180 | HCV 3b | 39 | 104 | 9 | B_4403 | GEARSADNL | 7040 | 12 |
| 181 | HCV 3b | 39 | 23 | 9 | B_4403 | RAIPLWCWF | 7041 | 10 |
| 182 | HCV 3b | 39 | 104 | 10 | B_4403 | GEARsADNLW | 7042 | 36 |
| 183 | HCV 3b | 39 | 78 | 10 | B_4403 | AERPqRSGTT | 7043 | 16 |
| 184 | HCV 3b | 39 | 145 | 10 | B_4403 | RGAPaPRVLY | 7044 | 12 |
| 185 | HCV 3b | 40 | | | | no hits | | |
| 186 | HCV 3b | 41 | 2 | 9 | B7 | APTVPDLSI | 7045 | 36 |
| 187 | HCV 3b | 41 | 11 | 9 | B_3501 | RPANSGTIW | 7046 | 20 |
| 188 | HCV 3b | 42 | 3 | 10 | B_3501 | RARRYLHTGY | 7047 | 36 |
| 189 | HCV 3b | 43 | 4 | 10 | A1 | TPEAdSARPY | 7048 | 11.25 |
| 190 | HCV 3b | 43 | 4 | 10 | B_3501 | TPEAdSARPY | 7049 | 12 |
| 191 | HCV 3b | 43 | 5 | 9 | B_4403 | PEADSARPY | 7050 | 36 |
| 192 | HCV 3b | 44 | 17 | 9 | B7 | AIQGQSPRL | 7051 | 12 |
| 193 | HCV 3b | 44 | 16 | 10 | B7 | SAIQgQSPRL | 7052 | 12 |
| 194 | HCV 3b | 44 | 5 | 10 | B_3501 | CSLHrASTGY | 7053 | 10 |
| 195 | HCV 3b | 44 | 5 | 10 | B_4403 | CSLHrASTGY | 7054 | 13.5 |
| 196 | HCV 3b | 45 | 2 | 9 | B_4403 | AESGGVLAT | 7055 | 36 |
| 197 | HCV 3b | 45 | 7 | 9 | A_0201 | VLATAHVEL | 7056 | 36.32 |
| 198 | HCV 3b | 45 | 35 | 9 | A24 | GFPYGLHRL | 7057 | 30 |
| 199 | HCV 3b | 45 | 31 | 10 | B7 | QPCRgFPYGL | 7058 | 80 |
| 200 | HCV 3b | 45 | 6 | 10 | B7 | GVLAtAHVEL | 7059 | 20 |
| 201 | HCV 3b | 45 | 47 | 10 | B7 | PPHNqPDYVL | 7060 | 12 |
| 202 | HCV 3b | 45 | 46 | 9 | B_3501 | QPPHNQPDY | 7061 | 40 |
| 203 | HCV 3b | 45 | 31 | 10 | B_3501 | QPCRgFPYGL | 7062 | 20 |
| 204 | HCV 3b | 45 | 2 | 9 | B_4403 | AESGGVLAT | 7063 | 36 |
| 205 | HCV 3b | 45 | 2 | 10 | B_4403 | AESGgVLATA | 7064 | 27 |
| 206 | HCV 3b | 46 | 28 | 10 | A24 | SGEPcITNTL | 7065 | 12.096 |
| 207 | HCV 3b | 46 | 24 | 10 | B7 | SVRIsGEPCI | 7066 | 20.000 |
| 208 | HCV 3b | 46 | 38 | 10 | B8 | CPRErRGSKS | 7067 | 12.000 |
| 209 | HCV 3b | 46 | 44 | 10 | B_3501 | GSKSnSIAEL | 7068 | 15.000 |
| 210 | HCV 3b | 46 | 38 | 10 | B_3501 | CPRErRGSKS | 7069 | 12.000 |
| 211 | HCV 3b | 46 | 51 | 9 | B_4403 | AELSNRHPI | 7070 | 16.000 |
| 212 | HCV 3b | 46 | 19 | 9 | B_4403 | DEQTHSVRI | 7071 | 12.000 |
| 213 | HCV 3b | 46 | 19 | 10 | B_4403 | DEQThSVRIS | 7072 | 36.000 |
| 214 | HCV 3b | 46 | 51 | 10 | B_4403 | AELSnRHPIA | 7073 | 16.000 |
| 215 | HCV 3b | 47 | 24 | 10 | A_0201 | RLYRtRKEWV | 7074 | 599.816 |
| 216 | HCV 3b | 47 | 17 | 9 | B7 | NALPLWGRL | 7075 | 12.000 |
| 217 | HCV 3b | 47 | 1 | 9 | B_3501 | MSKGVQGSM | 7076 | 30.000 |
| 218 | HCV 3b | 47 | 17 | 10 | B_4403 | NALPlWGRLY | 7077 | 12.000 |
| 219 | HCV 3b | 48 | 1 | 9 | B7 | MPGASARVL | 7078 | 80.000 |
| 220 | HCV 3b | 48 | 16 | 9 | B7 | EAPPLCSSL | 7079 | 12.000 |
| 221 | HCV 3b | 48 | 11 | 10 | B7 | RVRRsEAPPL | 7080 | 200.000 |
| 222 | HCV 3b | 48 | 1 | 9 | B_3501 | MPGASARVL | 7081 | 20.000 |
| 223 | HCV 3b | 48 | 15 | 9 | B_4403 | SEAPPLCSS | 7082 | 48.000 |
| 224 | HCV 3b | 48 | 15 | 10 | B_4403 | SEApPLCSSL | 7083 | 32.000 |
| 225 | HCV 3b | 49 | 28 | 9 | B7 | APCARFTSI | 7084 | 24.000 |

TABLE 4k-continued 3b (1-3)

| No. | Strain | ORF | Start | AA | HLA | Peptide sequence | SEQ ID NO: | Score |
|---|---|---|---|---|---|---|---|---|
| 226 | HCV 3b | 49 | 4 | 9 | B7 | RAGRRSVNL | 7085 | 12.000 |
| 227 | HCV 3b | 50 | 63 | 9 | A_0201 | ILLRSRYRI | 7086 | 65.622 |
| 228 | HCV 3b | 50 | 64 | 10 | A3 | LLRSrYRIHR | 7087 | 24.000 |
| 229 | HCV 3b | 50 | 8 | 9 | B7 | AARSSRVCL | 7088 | 540.000 |
| 230 | HCV 3b | 50 | 57 | 9 | B7 | TGRDRHILL | 7089 | 40.000 |
| 231 | HCV 3b | 50 | 7 | 10 | B7 | RAARsSRVCL | 7090 | 18.000 |
| 232 | HCV 3b | 50 | 57 | 9 | B8 | TGRDRHILL | 7091 | 24.000 |
| 233 | HCV 3b | 50 | 8 | 9 | B8 | AARSSRVCL | 7092 | 16.000 |
| 234 | HCV 3b | 50 | 5 | 10 | B8 | NLRAaRSSRV | 7093 | 24.000 |
| 235 | HCV 3b | 50 | 8 | 10 | B8 | AARSsRVCLA | 7094 | 16.000 |
| 236 | HCV 3b | 50 | 44 | 9 | B_3501 | TPCPGREIF | 7095 | 20.000 |
| 237 | HCV 3b | 50 | 49 | 9 | B_4403 | REIFPVDET | 7096 | 60.000 |
| 238 | HCV 3b | 50 | 55 | 9 | B_4403 | DETGRDRHI | 7097 | 18.000 |
| 239 | HCV 3b | 50 | 1 | 9 | B_4403 | MEGPNLRAA | 7098 | 12.000 |
| 240 | HCV 3b | 51 | 16 | 10 | A_0201 | LVAEtPQSCL | 7099 | 13.028 |
| 241 | HCV 3b | 51 | 25 | 9 | A3 | LLYVISKRR | 7100 | 15.000 |
| 242 | HCV 3b | 51 | 24 | 9 | A3 | CLLYVISKR | 7101 | 13.500 |
| 243 | HCV 3b | 51 | 16 | 10 | B7 | LVAEtPQSCL | 7102 | 30.000 |
| 244 | HCV 3b | 51 | 36 | 9 | B_4403 | SEEGYLRQT | 7103 | 18.000 |
| 245 | HCV 3b | 51 | 18 | 9 | B_4403 | AETPQSCLL | 7104 | 16.000 |
| 246 | HCV 3b | 51 | 18 | 10 | B_4403 | AETPqSCLLY | 7105 | 480.000 |
| 247 | HCV 3b | 51 | 36 | 10 | B_4403 | SEEGyLRQTA | 7106 | 12.000 |
| 248 | HCV 3b | 52 | | | | no hits | | |
| 249 | HCV 3b | 53 | | | | no hits | | |

TABLE 4l 3b (4-6)

| No. | Strain | ORF | Start | AA | HLA | Peptide sequence | SEQ ID NO: | Score |
|---|---|---|---|---|---|---|---|---|
| 1 | HCV 3b | 1 | | | | no hits | | |
| 2 | HCV 3b | 2 | | | | no hits | | |
| 3 | HCV 3b | 3 | 4 | 9 | B8 | DSRVKATSV | 7107 | 24.000 |
| 4 | HCV 3b | 4 | 1 | 9 | A_0201 | MLHSLFGRV | 7108 | 29.205 |
| 5 | HCV 3b | 4 | 9 | 10 | A1 | VLEPvGRPHR | 7109 | 180.000 |
| 6 | HCV 3b | 4 | 4 | 10 | A_0201 | SLFGrVLEPV | 7110 | 290.025 |
| 7 | HCV 3b | 4 | 1 | 10 | A_0201 | MLHSLFGRVL | 7111 | 11.316 |
| 8 | HCV 3b | 5 | 1 | 9 | A_0201 | MVIEHLQSV | 7112 | 97.561 |
| 9 | HCV 3b | 5 | 7 | 9 | B_3501 | QSVEGNLLL | 7113 | 10.000 |
| 10 | HCV 3b | 6 | 2 | 9 | B_3501 | RPVRLTSGF | 7114 | 40.000 |
| 11 | HCV 3b | 7 | 14 | 9 | A_0201 | GLTRRSIAV | 7115 | 69.552 |
| 12 | HCV 3b | 7 | 4 | 10 | A1 | YTEGdLVPQK | 7116 | 90.000 |
| 13 | HCV 3b | 8 | 17 | 9 | B7 | APQGTRVIV | 7117 | 18.000 |
| 14 | HCV 3b | 9 | 23 | 9 | A_0201 | YMPAQHCST | 7118 | 24.757 |
| 15 | HCV 3b | 9 | 24 | 9 | B_3501 | MPAQHCSTY | 7119 | 40.000 |
| 16 | HCV 3b | 9 | 8 | 10 | A24 | RYESvHPLHC | 7120 | 15.000 |
| 17 | HCV 3b | 9 | 6 | 10 | B_4403 | CERYeSVHPL | 7121 | 12.000 |
| 18 | HCV 3b | 10 | 1 | 9 | B_3501 | MPHDDDTTY | 7122 | 120.000 |
| 19 | HCV 3b | 11 | | | | no hits | | |
| 20 | HCV 3b | 12 | 60 | 9 | A_0201 | CLIQHRAYT | 7123 | 40.986 |
| 21 | HCV 3b | 12 | 18 | 9 | A_0201 | FAIKGDFSV | 7124 | 25.773 |
| 22 | HCV 3b | 12 | 90 | 9 | A24 | RTTPIGEEL | 7125 | 14.784 |
| 23 | HCV 3b | 12 | 13 | 9 | A3 | CQWEGFAIK | 7126 | 13.500 |
| 24 | HCV 3b | 12 | 53 | 9 | B7 | QPHPGCLCL | 7127 | 80.000 |
| 25 | HCV 3b | 12 | 25 | 9 | B7 | SVTGEAHLL | 7128 | 20.000 |
| 26 | HCV 3b | 12 | 53 | 9 | B_3501 | QPHPGCLCL | 7129 | 20.000 |
| 27 | HCV 3b | 12 | 95 | 9 | B_4403 | GEELAVCGV | 7130 | 18.000 |
| 28 | HCV 3b | 12 | 2 | 9 | B_4403 | AEYKVSSSL | 7131 | 12.000 |
| 29 | HCV 3b | 12 | 68 | 10 | A_0201 | TQYGgSVLRV | 7132 | 51.901 |
| 30 | HCV 3b | 12 | 79 | 10 | A_0201 | FIADdHVIGA | 7133 | 29.632 |
| 31 | HCV 3b | 12 | 50 | 10 | A24 | QYRQpHPGCL | 7134 | 200.000 |
| 32 | HCV 3b | 12 | 66 | 10 | A24 | AYTQyGGSVL | 7135 | 200.000 |
| 33 | HCV 3b | 12 | 23 | 10 | A24 | DFSVtGEAHL | 7136 | 20.000 |
| 34 | HCV 3b | 12 | 52 | 10 | A24 | RQPHpGCLCL | 7137 | 12.000 |
| 35 | HCV 3b | 12 | 15 | 10 | B_4403 | WEGFaIKGDF | 7138 | 40.000 |
| 36 | HCV 3b | 12 | 117 | 10 | B_4403 | TDVGvNPIGF | 7139 | 15.000 |
| 37 | HCV 3b | 13 | 16 | 9 | A_0201 | GLGGRGQHL | 7140 | 21.362 |
| 38 | HCV 3b | 13 | 9 | 9 | A24 | PYCRTQEGL | 7141 | 20.000 |
| 39 | HCV 3b | 13 | 18 | 9 | B7 | GGRGQHLHL | 7142 | 40.000 |
| 40 | HCV 3b | 14 | 4 | 9 | A_0201 | WLLLTAVTI | 7143 | 177.566 |
| 41 | HCV 3b | 14 | 2 | 9 | A_0201 | EQWLLLTAV | 7144 | 10.096 |

TABLE 4l-continued

3b (4-6)

| No. | Strain | ORF | Start | AA | HLA | Peptide sequence | SEQ ID NO: | Score |
|---|---|---|---|---|---|---|---|---|
| 42 | HCV 3b | 14 | 6 | 9 | A3 | LLTAVTIFK | 7145 | 60.000 |
| 43 | HCV 3b | 14 | 6 | 10 | A_0201 | LLTAvTIFKI | 7146 | 236.595 |
| 44 | HCV 3b | 14 | 5 | 10 | A3 | LLLTaVTIFK | 7147 | 90.000 |
| 45 | HCV 3b | 14 | 9 | 10 | B7 | AVTIfKITAL | 7148 | 60.000 |
| 46 | HCV 3b | 15 | 5 | 9 | A1 | SYEHSDLEY | 7149 | 11.250 |
| 47 | HCV 3b | 15 | 60 | 9 | A_0201 | KVGLICFNV | 7150 | 123.542 |
| 48 | HCV 3b | 15 | 20 | 9 | A_0201 | RIMPQSVRV | 7151 | 35.385 |
| 49 | HCV 3b | 15 | 67 | 9 | A_0201 | NVLHPPIDV | 7152 | 22.517 |
| 50 | HCV 3b | 15 | 21 | 9 | A_0201 | IMPQSVRVV | 7153 | 16.105 |
| 51 | HCV 3b | 15 | 50 | 9 | A_0201 | VLPETIGRA | 7154 | 10.353 |
| 52 | HCV 3b | 15 | 58 | 9 | A24 | AFKVGLICF | 7155 | 10.000 |
| 53 | HCV 3b | 15 | 28 | 9 | A3 | VVYQTPWRK | 7156 | 30.000 |
| 54 | HCV 3b | 15 | 75 | 9 | B7 | VARGSPTSL | 7157 | 120.000 |
| 55 | HCV 3b | 15 | 55 | 9 | B7 | IGRAFKVGL | 7158 | 40.000 |
| 56 | HCV 3b | 15 | 43 | 9 | B7 | AGKRGIMVL | 7159 | 12.000 |
| 57 | HCV 3b | 15 | 75 | 9 | B8 | VARGSPTSL | 7160 | 16.000 |
| 58 | HCV 3b | 15 | 22 | 9 | B_3501 | MPQSVRVVY | 7161 | 40.000 |
| 59 | HCV 3b | 15 | 14 | 9 | B_4403 | REVHSARIM | 7162 | 12.000 |
| 60 | HCV 3b | 15 | 11 | 9 | B_4403 | LEYREVHSA | 7163 | 12.000 |
| 61 | HCV 3b | 15 | 2 | 10 | A_0201 | FMSSyEHSDL | 7164 | 70.971 |
| 62 | HCV 3b | 15 | 54 | 10 | A_0201 | TIGRaFKVGL | 7165 | 11.162 |
| 63 | HCV 3b | 15 | 12 | 10 | A24 | EYREvHSARI | 7166 | 60.000 |
| 64 | HCV 3b | 15 | 60 | 10 | A24 | KVGLiCFNVL | 7167 | 11.520 |
| 65 | HCV 3b | 15 | 48 | 10 | A3 | IMVLpETIGR | 7168 | 12.000 |
| 66 | HCV 3b | 15 | 90 | 10 | B7 | HPHTsKPPAL | 7169 | 80.000 |
| 67 | HCV 3b | 15 | 42 | 10 | B7 | AAGKrGIMVL | 7170 | 36.000 |
| 68 | HCV 3b | 15 | 40 | 10 | B7 | GPAAgKRGIM | 7171 | 30.000 |
| 69 | HCV 3b | 15 | 74 | 10 | B7 | DVARgSPTSL | 7172 | 20.000 |
| 70 | HCV 3b | 15 | 60 | 10 | B7 | KVGLiCFNVL | 7173 | 20.000 |
| 71 | HCV 3b | 15 | 90 | 10 | B8 | HPHTsKPPAL | 7174 | 16.000 |
| 72 | HCV 3b | 15 | 40 | 10 | B_3501 | GPAAgKRGIM | 7175 | 40.000 |
| 73 | HCV 3b | 15 | 90 | 10 | B_3501 | HPHTsKPPAL | 7176 | 20.000 |
| 74 | HCV 3b | 15 | 4 | 10 | B_3501 | SSYEhSDLEY | 7177 | 20.000 |
| 75 | HCV 3b | 15 | 75 | 10 | B_3501 | VARGsPTSLY | 7178 | 18.000 |
| 76 | HCV 3b | 16 | | | | no hits | | |
| 77 | HCV 3b | 17 | 2 | 9 | B_4403 | SEGSCDAPY | 7179 | 240.000 |
| 78 | HCV 3b | 17 | 14 | 9 | B_4403 | DERNVPHEV | 7180 | 18.000 |
| 79 | HCV 3b | 17 | 1 | 10 | A1 | MSEGsCDAPY | 7181 | 135.000 |
| 80 | HCV 3b | 18 | 9 | 9 | A3 | KMKSAPSRR | 7182 | 12.000 |
| 81 | HCV 3b | 18 | 11 | 10 | A_0201 | KSAPsRRWAV | 7183 | 11.918 |
| 82 | HCV 3b | 18 | 1 | 10 | B7 | MPRRrLRSKM | 7184 | 300.000 |
| 83 | HCV 3b | 18 | 1 | 10 | B_3501 | MPRRrLRSKM | 7185 | 120.000 |
| 84 | HCV 3b | 19 | | | | no hits | | |
| 85 | HCV 3b | 20 | 6 | 9 | B_3501 | RAGDPSPQM | 7186 | 24.000 |
| 86 | HCV 3b | 20 | 6 | 10 | A24 | RAGDpSPQML | 7187 | 11.520 |
| 87 | HCV 3b | 20 | 6 | 10 | B7 | RAGDpSPQML | 7188 | 12.000 |
| 88 | HCV 3b | 20 | 6 | 10 | B_3501 | RAGDpSPQML | 7189 | 12.000 |
| 89 | HCV 3b | 21 | 3 | 9 | A_0201 | LLWRQSRSM | 7190 | 14.020 |
| 90 | HCV 3b | 21 | 3 | 10 | A_0201 | LLWRqSRSMT | 7191 | 105.148 |
| 91 | HCV 3b | 22 | 22 | 9 | A_0201 | YLLLRRMCL | 7192 | 363.588 |
| 92 | HCV 3b | 22 | 39 | 9 | A_0201 | KISLPGQGV | 7193 | 33.472 |
| 93 | HCV 3b | 22 | 29 | 9 | A_0201 | CLSLPVSST | 7194 | 17.140 |
| 94 | HCV 3b | 22 | 20 | 9 | A_0201 | ILYLLLRRM | 7195 | 12.432 |
| 95 | HCV 3b | 22 | 15 | 9 | A24 | RTQRWILYL | 7196 | 12.000 |
| 96 | HCV 3b | 22 | 31 | 9 | A3 | SLPVSSTGK | 7197 | 20.000 |
| 97 | HCV 3b | 22 | 16 | 9 | B7 | TQRWILYLL | 7198 | 40.000 |
| 98 | HCV 3b | 22 | 24 | 9 | B7 | LLRRMCLSL | 7199 | 40.000 |
| 99 | HCV 3b | 22 | 2 | 9 | B_3501 | TPRPILRQF | 7200 | 60.000 |
| 100 | HCV 3b | 22 | 23 | 10 | A_0201 | LLLRrMCLSL | 7201 | 134.369 |
| 101 | HCV 3b | 22 | 41 | 10 | A_0201 | SLPGqGVPRT | 7202 | 17.140 |
| 102 | HCV 3b | 22 | 21 | 10 | A24 | LYLLLRRMCL | 7203 | 300.000 |
| 103 | HCV 3b | 22 | 15 | 10 | A24 | RTQRwILYLL | 7204 | 16.800 |
| 104 | HCV 3b | 22 | 16 | 10 | B7 | TQRWiLYLLL | 7205 | 40.000 |
| 105 | HCV 3b | 22 | 47 | 10 | B7 | VPRThSTHRA | 7206 | 20.000 |
| 106 | HCV 3b | 22 | 12 | 10 | B7 | ASHRtQRWIL | 7207 | 18.000 |
| 107 | HCV 3b | 23 | | | | no hits | | |
| 108 | HCV 3b | 24 | 1 | 9 | B_4403 | MEVNRAQGA | 7208 | 12.000 |
| 109 | HCV 3b | 24 | 3 | 10 | B7 | VNRAqGAGPL | 7209 | 40.000 |
| 110 | HCV 3b | 25 | | | | no hits | | |
| 111 | HCV 3b | 26 | 42 | 9 | A_0201 | RVYSAQWCI | 7210 | 21.909 |
| 112 | HCV 3b | 26 | 21 | 9 | B7 | APRHNCRRS | 7211 | 12.000 |
| 113 | HCV 3b | 26 | 38 | 9 | B8 | CARGRVYSA | 7212 | 16.000 |
| 114 | HCV 3b | 26 | 7 | 10 | B_3501 | RSWPpPRNEY | 7213 | 20.000 |
| 115 | HCV 3b | 26 | 11 | 10 | B_3501 | PPRNeYPPPY | 7214 | 12.000 |
| 116 | HCV 3b | 26 | 35 | 10 | B_3501 | ASNCaRGRVY | 7215 | 10.000 |

TABLE 4l-continued

3b (4-6)

| No. | Strain | ORF | Start | AA | HLA | Peptide sequence | SEQ ID NO: | Score |
|---|---|---|---|---|---|---|---|---|
| 117 | HCV 3b | 27 | 2 | 9 | B_4403 | RERVCLAPW | 7216 | 18.000 |
| 118 | HCV 3b | 28 | 6 | 10 | B7 | LPRRsRGHSV | 7217 | 40.000 |
| 119 | HCV 3b | 28 | 6 | 10 | B8 | LPRRsRGHSV | 7218 | 48.000 |
| 120 | HCV 3b | 28 | 6 | 10 | B_3501 | LPRRsRGHSV | 7219 | 12.000 |
| 121 | HCV 3b | 28 | 9 | 10 | B_3501 | RSRGhSVLVI | 7220 | 12.000 |
| 122 | HCV 3b | 29 | 2 | 9 | A_0201 | LQVPLGVWL | 7221 | 20.251 |
| 123 | HCV 3b | 29 | 1 | 10 | A_0201 | MLQVpLGVWL | 7222 | 199.738 |
| 124 | HCV 3b | 29 | 4 | 10 | B7 | VPLGvWLPNL | 7223 | 80.000 |
| 125 | HCV 3b | 29 | 4 | 10 | B_3501 | VPLGvWLPNL | 7224 | 20.000 |
| 126 | HCV 3b | 30 | 21 | 9 | A_0201 | SLGPAVLPV | 7225 | 159.970 |
| 127 | HCV 3b | 30 | 18 | 9 | A_0201 | SMQSLGPAV | 7226 | 50.232 |
| 128 | HCV 3b | 30 | 5 | 9 | A_0201 | PLHERRQWL | 7227 | 10.598 |
| 129 | HCV 3b | 30 | 27 | 9 | B7 | LPVTRSGHL | 7228 | 80.000 |
| 130 | HCV 3b | 30 | 27 | 9 | B8 | LPVTRSGHL | 7229 | 16.000 |
| 131 | HCV 3b | 30 | 27 | 9 | B_3501 | LPVTRSGHL | 7230 | 20.000 |
| 132 | HCV 3b | 30 | 4 | 9 | B_3501 | SPLHERRQW | 7231 | 15.000 |
| 133 | HCV 3b | 30 | 4 | 10 | B7 | SPLHeRRQWL | 7232 | 120.000 |
| 134 | HCV 3b | 30 | 4 | 10 | B8 | SPLHeRRQWL | 7233 | 16.000 |
| 135 | HCV 3b | 30 | 27 | 10 | B_3501 | LPVTrSGHLY | 7234 | 40.000 |
| 136 | HCV 3b | 30 | 4 | 10 | B_3501 | SPLHeRRQWL | 7235 | 20.000 |
| 137 | HCV 3b | 31 | 11 | 9 | B7 | VVGHTRNNL | 7236 | 30.000 |
| 138 | HCV 3b | 31 | 10 | 10 | B7 | QVVGhTRNNL | 7237 | 30.000 |
| 139 | HCV 3b | 32 | 23 | 9 | A24 | RFQWGREGI | 7238 | 15.000 |
| 140 | HCV 3b | 32 | 24 | 10 | A_0201 | FQWGrEGILL | 7239 | 82.694 |
| 141 | HCV 3b | 32 | 23 | 10 | A24 | RFQWgREGIL | 7240 | 60.000 |
| 142 | HCV 3b | 32 | 9 | 10 | B7 | IPVQhKRRGL | 7241 | 120.000 |
| 143 | HCV 3b | 32 | 9 | 10 | B8 | IPVQhKRRGL | 7242 | 16.000 |
| 144 | HCV 3b | 32 | 9 | 10 | B_3501 | IPVQhKRRGL | 7243 | 20.000 |
| 145 | HCV 3b | 33 | 36 | 9 | A24 | RCLRRLLCL | 7244 | 12.000 |
| 146 | HCV 3b | 33 | 34 | 9 | B7 | RTRCLRRLL | 7245 | 60.000 |
| 147 | HCV 3b | 33 | 32 | 10 | B7 | ATRTrCLRRL | 7246 | 120.000 |
| 148 | HCV 3b | 34 | 5 | 10 | A_0201 | MQPGtRRNPV | 7247 | 11.988 |
| 149 | HCV 3b | 34 | 8 | 10 | B7 | GTRRnPVVPL | 7248 | 60.000 |
| 150 | HCV 3b | 35 | 39 | 9 | A1 | RIDVHVLLR | 7249 | 25.000 |
| 151 | HCV 3b | 35 | 30 | 9 | B7 | LPSSSCRRL | 7250 | 80.000 |
| 152 | HCV 3b | 35 | 37 | 9 | B7 | RLRIDVHVL | 7251 | 40.000 |
| 153 | HCV 3b | 35 | 16 | 9 | B7 | VVAHCGHDL | 7252 | 20.000 |
| 154 | HCV 3b | 35 | 3 | 9 | B7 | MAILASQSL | 7253 | 12.000 |
| 155 | HCV 3b | 35 | 30 | 9 | B_3501 | LPSSSCRRL | 7254 | 20.000 |
| 156 | HCV 3b | 35 | 5 | 10 | A_0201 | ILASqSLNGA | 7255 | 19.425 |
| 157 | HCV 3b | 35 | 2 | 10 | A_0201 | SMAILASQSL | 7256 | 15.428 |
| 158 | HCV 3b | 35 | 37 | 10 | A24 | RLRIdVHVLL | 7257 | 11.200 |
| 159 | HCV 3b | 35 | 37 | 10 | B7 | RLRIdVHVLL | 7258 | 40.000 |
| 160 | HCV 3b | 35 | 15 | 10 | B7 | VVVAhCGHDL | 7259 | 20.000 |
| 161 | HCV 3b | 35 | 29 | 10 | B7 | ALPSsSCRRL | 7260 | 12.000 |
| 162 | HCV 3b | 35 | 40 | 10 | B_4403 | IDVHvLLRTF | 7261 | 15.000 |
| 163 | HCV 3b | 36 | 1 | 9 | B7 | MVCPHWDHL | 7262 | 20.000 |
| 164 | HCV 3b | 37 | 22 | 9 | B_3501 | RPHTQCSCW | 7263 | 20.000 |
| 165 | HCV 3b | 37 | 4 | 10 | B8 | CCRFrRRARI | 7264 | 80.000 |
| 166 | HCV 3b | 37 | 16 | 10 | B8 | SARSrRRPHT | 7265 | 16.000 |
| 167 | HCV 3b | 38 | 8 | 9 | A1 | GLEAARHSY | 7266 | 45.000 |
| 168 | HCV 3b | 38 | 8 | 9 | A3 | GLEAARHSY | 7267 | 12.000 |
| 169 | HCV 3b | 38 | 1 | 9 | B7 | MALPEGGGL | 7268 | 12.000 |
| 170 | HCV 3b | 38 | 2 | 10 | A_0201 | ALPEgGGLEA | 7269 | 20.369 |
| 171 | HCV 3b | 39 | | | | no hits | | |
| 172 | HCV 3b | 40 | 41 | 9 | A_0201 | ILAFPPWAM | 7270 | 63.342 |
| 173 | HCV 3b | 40 | 19 | 9 | A_0201 | AVGNGVSLV | 7271 | 13.997 |
| 174 | HCV 3b | 40 | 26 | 9 | A_0201 | LVLVRTAQL | 7272 | 11.757 |
| 175 | HCV 3b | 40 | 36 | 9 | A24 | RYRPHILAF | 7273 | 240.000 |
| 176 | HCV 3b | 40 | 43 | 9 | A24 | AFPPWAMSL | 7274 | 36.000 |
| 177 | HCV 3b | 40 | 69 | 9 | A24 | SFLRAPATL | 7275 | 30.000 |
| 178 | HCV 3b | 40 | 27 | 9 | A3 | VLVRTAQLK | 7276 | 30.000 |
| 179 | HCV 3b | 40 | 70 | 9 | B7 | FLRAPATLL | 7277 | 60.000 |
| 180 | HCV 3b | 40 | 26 | 9 | B7 | LVLVRTAQL | 7278 | 20.000 |
| 181 | HCV 3b | 40 | 73 | 9 | B7 | APATLLSSV | 7279 | 12.000 |
| 182 | HCV 3b | 40 | 54 | 9 | B8 | TARARCLHA | 7280 | 16.000 |
| 183 | HCV 3b | 40 | 10 | 10 | A_0201 | NQLErSSWPA | 7281 | 57.308 |
| 184 | HCV 3b | 40 | 25 | 10 | A_0201 | SLVLvRTAQL | 7282 | 21.362 |
| 185 | HCV 3b | 40 | 69 | 10 | A24 | SFLRaPATLL | 7283 | 30.000 |
| 186 | HCV 3b | 40 | 27 | 10 | A3 | VLVRtAQLKR | 7284 | 12.000 |
| 187 | HCV 3b | 40 | 51 | 10 | B7 | LARTaRARCL | 7285 | 120.000 |
| 188 | HCV 3b | 40 | 3 | 10 | B7 | FPPTpTVNQL | 7286 | 80.000 |
| 189 | HCV 3b | 40 | 17 | 10 | B7 | WPAVgNGVSL | 7287 | 80.000 |
| 190 | HCV 3b | 40 | 19 | 10 | B7 | AVGNgVSLVL | 7288 | 60.000 |
| 191 | HCV 3b | 40 | 62 | 10 | B7 | ARRGgIPSFL | 7289 | 12.000 |

TABLE 4l-continued 3b (4-6)

| No. Strain | ORF | Start | AA | HLA | Peptide sequence | SEQ ID NO: | Score |
|---|---|---|---|---|---|---|---|
| 192 HCV 3b | 40 | 42 | 10 | B7 | LAFPpWAMSL | 7290 | 12.000 |
| 193 HCV 3b | 40 | 51 | 10 | B8 | LARTaRARCL | 7291 | 320.000 |
| 194 HCV 3b | 40 | 33 | 10 | B8 | QLKRyRPHIL | 7292 | 160.000 |
| 195 HCV 3b | 40 | 3 | 10 | B_3501 | FPPTpTVNQL | 7293 | 20.000 |
| 196 HCV 3b | 40 | 38 | 10 | B_3501 | RPHILAFPPW | 7294 | 20.000 |
| 197 HCV 3b | 40 | 17 | 10 | B_3501 | WPAVgNGVSL | 7295 | 20.000 |
| 198 HCV 3b | 41 | 1 | 9 | A_0201 | MIAGKSSGV | 7296 | 16.258 |
| 199 HCV 3b | 42 | 19 | 9 | A_0201 | MMIFPNQEL | 7297 | 26.228 |
| 200 HCV 3b | 42 | 25 | 9 | B_4403 | QELTGVWRA | 7298 | 24.000 |
| 201 HCV 3b | 42 | 1 | 9 | B_4403 | MEKKWVINT | 7299 | 12.000 |
| 202 HCV 3b | 42 | 18 | 10 | A_0201 | NMMIfPNQEL | 7300 | 57.085 |
| 203 HCV 3b | 42 | 6 | 10 | A_0201 | VINTmRTQMV | 7301 | 16.258 |
| 204 HCV 3b | 42 | 13 | 10 | A3 | QMVGaNMMIF | 7302 | 13.500 |
| 205 HCV 3b | 42 | 18 | 10 | B7 | NMMIfPNQEL | 7303 | 18.000 |
| 206 HCV 3b | 42 | 22 | 10 | B_3501 | FPNQeLTGVW | 7304 | 10.000 |
| 207 HCV 3b | 42 | 25 | 10 | B_4403 | QELTgVWRAV | 7305 | 12.000 |
| 208 HCV 3b | 43 | 39 | 9 | A_0201 | ALLAAVALM | 7306 | 42.278 |
| 209 HCV 3b | 43 | 10 | 9 | A_0201 | VLSSSTPQL | 7307 | 36.316 |
| 210 HCV 3b | 43 | 33 | 9 | A24 | GFLRPAALL | 7308 | 30.000 |
| 211 HCV 3b | 43 | 38 | 9 | B7 | AALLAAVAL | 7309 | 36.000 |
| 212 HCV 3b | 43 | 3 | 9 | B7 | SVKARRAVL | 7310 | 30.000 |
| 213 HCV 3b | 43 | 3 | 9 | B8 | SVKARRAVL | 7311 | 80.000 |
| 214 HCV 3b | 43 | 26 | 9 | B_3501 | SPQTRKDGF | 7312 | 20.000 |
| 215 HCV 3b | 43 | 26 | 10 | B7 | SPQTrKDGFL | 7313 | 80.000 |
| 216 HCV 3b | 43 | 9 | 10 | B7 | AVLSsSTPQL | 7314 | 60.000 |
| 217 HCV 3b | 43 | 2 | 10 | B7 | ASVKaRRAVL | 7315 | 18.000 |
| 218 HCV 3b | 43 | 26 | 10 | B8 | SPQTrKDGFL | 7316 | 16.000 |
| 219 HCV 3b | 43 | 26 | 10 | B_3501 | SPQTrKDGFL | 7317 | 20.000 |
| 220 HCV 3b | 44 | 32 | 9 | A_0201 | VLMSCSVTV | 7318 | 437.482 |
| 221 HCV 3b | 44 | 46 | 9 | A_0201 | VSYENPKGV | 7319 | 10.126 |
| 222 HCV 3b | 44 | 5 | 9 | A24 | MYSRSVRAL | 7320 | 200.000 |
| 223 HCV 3b | 44 | 47 | 9 | A24 | SYENPKGVF | 7321 | 150.000 |
| 224 HCV 3b | 44 | 26 | 9 | A24 | WYIPSSVLM | 7322 | 45.000 |
| 225 HCV 3b | 44 | 53 | 9 | B7 | GVFFDVHIL | 7323 | 20.000 |
| 226 HCV 3b | 44 | 50 | 9 | B_3501 | NPKGVFFDV | 7324 | 12.000 |
| 227 HCV 3b | 44 | 64 | 9 | B_3501 | CSTRCLGEY | 7325 | 10.000 |
| 228 HCV 3b | 44 | 8 | 9 | B_3501 | RSVRALIAF | 7326 | 10.000 |
| 229 HCV 3b | 44 | 48 | 9 | B_4403 | YENPKGVFF | 7327 | 120.000 |
| 230 HCV 3b | 44 | 40 | 9 | B_4403 | VESKQRVSY | 7328 | 120.000 |
| 231 HCV 3b | 44 | 39 | 10 | A1 | TVESkQRVSY | 7329 | 90.000 |
| 232 HCV 3b | 44 | 31 | 10 | A_0201 | SVLMsCSVTV | 7330 | 22.517 |
| 233 HCV 3b | 44 | 47 | 10 | A24 | SYENpKGVFF | 7331 | 150.000 |
| 234 HCV 3b | 44 | 5 | 10 | A24 | MYSRsVRALI | 7332 | 70.000 |
| 235 HCV 3b | 44 | 52 | 10 | A24 | KGVFfDVHIL | 7333 | 12.000 |
| 236 HCV 3b | 44 | 53 | 10 | A3 | GVFFdVHILR | 7334 | 18.000 |
| 237 HCV 3b | 44 | 60 | 10 | B7 | ILRRcSTRCL | 7335 | 40.000 |
| 238 HCV 3b | 44 | 18 | 10 | B_3501 | ASGSrSQHWY | 7336 | 10.000 |
| 239 HCV 3b | 44 | 46 | 10 | B_3501 | VSYEnPKGVF | 7337 | 10.000 |
| 240 HCV 3b | 45 | 37 | 9 | A_0201 | SQTERIWFM | 7338 | 195.933 |
| 241 HCV 3b | 45 | 14 | 9 | A_0201 | TLNTSFFAI | 7339 | 114.969 |
| 242 HCV 3b | 45 | 13 | 9 | A_0201 | FTLNTSFFA | 7340 | 37.463 |
| 243 HCV 3b | 45 | 21 | 9 | A_0201 | AIMVVGIGV | 7341 | 35.385 |
| 244 HCV 3b | 45 | 82 | 9 | A_0201 | FTPDARSFT | 7342 | 10.736 |
| 245 HCV 3b | 45 | 88 | 9 | A24 | SFTSLSTFL | 7343 | 24.000 |
| 246 HCV 3b | 45 | 7 | 9 | A24 | RPPFAGFTL | 7344 | 12.000 |
| 247 HCV 3b | 45 | 12 | 9 | A24 | GFTLNTSFF | 7345 | 10.000 |
| 248 HCV 3b | 45 | 5 | 9 | A3 | GLRPPFAGF | 7346 | 40.500 |
| 249 HCV 3b | 45 | 7 | 9 | B7 | RPPFAGFTL | 7347 | 80.000 |
| 250 HCV 3b | 45 | 23 | 9 | B7 | MVVGIGVLL | 7348 | 20.000 |
| 251 HCV 3b | 45 | 7 | 9 | B_3501 | RPPFAGFTL | 7349 | 40.000 |
| 252 HCV 3b | 45 | 74 | 9 | B_3501 | SSKESRRPF | 7350 | 30.000 |
| 253 HCV 3b | 45 | 58 | 9 | B_3501 | YPYFDRPEW | 7351 | 15.000 |
| 254 HCV 3b | 45 | 87 | 9 | B_3501 | RSFTSLSTF | 7352 | 10.000 |
| 255 HCV 3b | 45 | 50 | 9 | B_4403 | KERTSFALY | 7353 | 120.000 |
| 256 HCV 3b | 45 | 13 | 10 | A_0201 | FTLNtSFFAI | 7354 | 27.178 |
| 257 HCV 3b | 45 | 22 | 10 | A_0201 | IMVVgIGVLL | 7355 | 26.228 |
| 258 HCV 3b | 45 | 37 | 10 | A_0201 | SQTErIWFMA | 7356 | 20.363 |
| 259 HCV 3b | 45 | 47 | 10 | A_0201 | LLDKeRTSFA | 7357 | 18.580 |
| 260 HCV 3b | 45 | 14 | 10 | A_0201 | TLNTsFFAIM | 7358 | 14.706 |
| 261 HCV 3b | 45 | 30 | 10 | A_0201 | LLSSnKSSQT | 7359 | 12.668 |
| 262 HCV 3b | 45 | 44 | 10 | A_0201 | FMALlDKERT | 7360 | 12.131 |
| 263 HCV 3b | 45 | 41 | 10 | A3 | RIWFmALLDK | 7361 | 30.000 |
| 264 HCV 3b | 45 | 21 | 10 | B7 | AIMVvGIGVL | 7362 | 36.000 |
| 265 HCV 3b | 45 | 83 | 10 | B7 | TPDArSFTSL | 7363 | 24.000 |
| 266 HCV 3b | 45 | 80 | 10 | B_3501 | RPFTpDARSF | 7364 | 60.000 |

TABLE 4l-continued

3b (4-6)

| No. | Strain | ORF | Start | AA | HLA | Peptide sequence | SEQ ID NO: | Score |
|---|---|---|---|---|---|---|---|---|
| 267 | HCV 3b | 45 | 35 | 10 | B_3501 | KSSQtERIWF | 7365 | 15.000 |
| 268 | HCV 3b | 45 | 36 | 10 | B_3501 | SSQTeRIWFM | 7366 | 10.000 |
| 269 | HCV 3b | 45 | 87 | 10 | B_3501 | RSFTsLSTFL | 7367 | 10.000 |
| 270 | HCV 3b | 45 | 22 | 9 | A1 | TVDQESASR | 7368 | 10.000 |
| 271 | HCV 3b | 46 | 97 | 9 | B_3501 | DPSSLIVLF | 7369 | 20.000 |
| 272 | HCV 3b | 46 | 88 | 9 | B_3501 | RARSAADTF | 7370 | 18.000 |
| 273 | HCV 3b | 46 | 71 | 9 | B_4403 | EDVPVPSGF | 7371 | 30.000 |
| 274 | HCV 3b | 46 | 43 | 9 | B_4403 | DEYDSTSDS | 7372 | 18.000 |
| 275 | HCV 3b | 46 | 14 | 10 | A_0201 | TLCSsESLTV | 7373 | 69.552 |
| 276 | HCV 3b | 46 | 6 | 10 | A24 | EYDIeQQTTL | 7374 | 200.000 |
| 277 | HCV 3b | 46 | 95 | 10 | A24 | TFDPsSLIVL | 7375 | 24.000 |
| 278 | HCV 3b | 46 | 97 | 10 | B7 | DPSSLIVLFL | 7376 | 80.000 |
| 279 | HCV 3b | 46 | 33 | 10 | B7 | SPGSpSRGGM | 7377 | 30.000 |
| 280 | HCV 3b | 46 | 92 | 10 | B7 | AADTfDPSSL | 7378 | 10.800 |
| 281 | HCV 3b | 46 | 33 | 10 | B_3501 | SPGSpSRGGM | 7379 | 40.000 |
| 282 | HCV 3b | 46 | 36 | 10 | B_3501 | SPSRgGMDEY | 7380 | 40.000 |
| 283 | HCV 3b | 46 | 97 | 10 | B_3501 | DPSSLIVLFL | 7381 | 20.000 |
| 284 | HCV 3b | 46 | 70 | 10 | B_4403 | EEDVpVPSGF | 7382 | 60.000 |
| 285 | HCV 3b | 46 | 18 | 10 | B_4403 | SESLtVDQES | 7383 | 12.000 |
| 286 | HCV 3b | 46 | 43 | 10 | B_4403 | DEYDsTSDSS | 7384 | 12.000 |
| 287 | HCV 3b | 46 | 56 | 10 | B_4403 | GESPdSAVDS | 7385 | 12.000 |
| 288 | HCV 3b | 47 | 17 | 9 | A_0201 | ILMDPFLTC | 7386 | 243.428 |
| 289 | HCV 3b | 47 | 16 | 9 | A_0201 | AILMDPFLT | 7387 | 21.989 |
| 290 | HCV 3b | 47 | 10 | 9 | B7 | AQRPDPAIL | 7388 | 120.000 |
| 291 | HCV 3b | 47 | 39 | 9 | B7 | TPSPRHTPL | 7389 | 80.000 |
| 292 | HCV 3b | 47 | 30 | 9 | B7 | SPQGQRVVI | 7390 | 12.000 |
| 293 | HCV 3b | 47 | 39 | 9 | B8 | TPSPRHTPL | 7391 | 16.000 |
| 294 | HCV 3b | 47 | 14 | 9 | B_3501 | DPAILMDPF | 7392 | 20.000 |
| 295 | HCV 3b | 47 | 39 | 9 | B_3501 | TPSPRHTPL | 7393 | 20.000 |
| 296 | HCV 3b | 47 | 18 | 10 | A_0201 | LMDPfLTCPV | 7394 | 34.158 |
| 297 | HCV 3b | 47 | 8 | 10 | A_0201 | MLAQrPDPAI | 7395 | 17.736 |
| 298 | HCV 3b | 47 | 14 | 10 | B7 | DPAIlMDPFL | 7396 | 80.000 |
| 299 | HCV 3b | 47 | 10 | 10 | B7 | AQRPdPAILM | 7397 | 45.000 |
| 300 | HCV 3b | 47 | 9 | 10 | B7 | LAQRpDPAIL | 7398 | 12.000 |
| 301 | HCV 3b | 47 | 41 | 10 | B_3501 | SPRHtPLYPF | 7399 | 60.000 |
| 302 | HCV 3b | 47 | 39 | 10 | B_3501 | TPSPrHTPLY | 7400 | 40.000 |
| 303 | HCV 3b | 47 | 14 | 10 | B_3501 | DPAILMDPFL | 7401 | 20.000 |
| 304 | HCV 3b | 48 | 6 | 9 | A_0201 | GMILAESQV | 7402 | 50.232 |
| 305 | HCV 3b | 48 | 26 | 9 | A_0201 | QMSCNQSPL | 7403 | 15.428 |
| 306 | HCV 3b | 48 | 8 | 9 | A3 | ILAESQVLK | 7404 | 30.000 |
| 307 | HCV 3b | 48 | 1 | 9 | B7 | MPGTLGMIL | 7405 | 80.000 |
| 308 | HCV 3b | 48 | 1 | 9 | B_3501 | MPGTLGMIL | 7406 | 20.000 |
| 309 | HCV 3b | 48 | 10 | 9 | B_4403 | AESQVLKSL | 7407 | 27.000 |
| 310 | HCV 3b | 48 | 25 | 10 | B7 | SQMScNQSPL | 7408 | 12.000 |
| 311 | HCV 3b | 48 | 18 | 10 | B_3501 | LSTIqTQSQM | 7409 | 10.000 |
| 312 | HCV 3b | 49 | 123 | 9 | A1 | VTEAVKAIR | 7410 | 45.000 |
| 313 | HCV 3b | 49 | 104 | 9 | A1 | ATQPPRMLK | 7411 | 25.000 |
| 314 | HCV 3b | 49 | 47 | 9 | A1 | GSSPPMILK | 7412 | 15.000 |
| 315 | HCV 3b | 49 | 109 | 9 | A_0201 | RMLKNIVWL | 7413 | 722.126 |
| 316 | HCV 3b | 49 | 110 | 9 | A_0201 | MLKNIVWLV | 7414 | 71.386 |
| 317 | HCV 3b | 49 | 148 | 9 | A_0201 | WIPLTKFHM | 7415 | 18.225 |
| 318 | HCV 3b | 49 | 74 | 9 | A_0201 | TLPMPMPPT | 7416 | 17.140 |
| 319 | HCV 3b | 49 | 122 | 9 | A_0201 | LVTEAVKAI | 7417 | 14.634 |
| 320 | HCV 3b | 49 | 116 | 9 | A_0201 | WLVVRGLVT | 7418 | 14.054 |
| 321 | HCV 3b | 49 | 34 | 9 | A_0201 | KMAGRRLTM | 7419 | 12.558 |
| 322 | HCV 3b | 49 | 114 | 9 | A_0201 | IVWLVVRGL | 7420 | 12.132 |
| 323 | HCV 3b | 49 | 146 | 9 | A24 | RYWIPLTKF | 7421 | 220.000 |
| 324 | HCV 3b | 49 | 109 | 9 | A24 | RMLKNIVWL | 7422 | 12.000 |
| 325 | HCV 3b | 49 | 129 | 9 | B7 | AIREATAGL | 7423 | 120.000 |
| 326 | HCV 3b | 49 | 143 | 9 | B7 | RPARYWIPL | 7424 | 80.000 |
| 327 | HCV 3b | 49 | 186 | 9 | B7 | KPRTLSLNC | 7425 | 20.000 |
| 328 | HCV 3b | 49 | 114 | 9 | B7 | IVWLVVRGL | 7426 | 20.000 |
| 329 | HCV 3b | 49 | 103 | 9 | B7 | VATQPPRML | 7427 | 18.000 |
| 330 | HCV 3b | 49 | 182 | 9 | B7 | ALCSKPRTL | 7428 | 12.000 |
| 331 | HCV 3b | 49 | 184 | 9 | B8 | CSKPRTLSL | 7429 | 80.000 |
| 332 | HCV 3b | 49 | 143 | 9 | B_3501 | RPARYWIPL | 7430 | 40.000 |
| 333 | HCV 3b | 49 | 58 | 9 | B_3501 | RAPETPAPY | 7431 | 24.000 |
| 334 | HCV 3b | 49 | 139 | 9 | B_3501 | GSVERPARY | 7432 | 20.000 |
| 335 | HCV 3b | 49 | 184 | 9 | B_3501 | CSKPRTLSL | 7433 | 15.000 |
| 336 | HCV 3b | 49 | 186 | 9 | B_3501 | KPRTLSLNC | 7434 | 12.000 |
| 337 | HCV 3b | 49 | 71 | 9 | B_3501 | SSNTLPMPM | 7435 | 10.000 |
| 338 | HCV 3b | 49 | 141 | 9 | B_4403 | VERPARYWI | 7436 | 12.000 |
| 339 | HCV 3b | 49 | 92 | 10 | A1 | NAEDaAGPAR | 7437 | 18.000 |
| 340 | HCV 3b | 49 | 109 | 10 | A_0201 | RMLKnIVWLV | 7438 | 3.206.057 |
| 341 | HCV 3b | 49 | 180 | 10 | A_0201 | WLALcSKPRT | 7439 | 34.279 |

TABLE 4l-continued

3b (4-6)

| No. Strain | ORF | Start | AA | HLA | Peptide sequence | SEQ ID NO: | Score |
|---|---|---|---|---|---|---|---|
| 342 HCV 3b | 49 | 121 | 10 | A_0201 | GLVTeAVKAI | 7440 | 23.995 |
| 343 HCV 3b | 49 | 114 | 10 | A_0201 | IVWLvVRGLV | 7441 | 11.163 |
| 344 HCV 3b | 49 | 128 | 10 | A24 | KAIReATAGL | 7442 | 12.000 |
| 345 HCV 3b | 49 | 66 | 10 | B7 | YPAStSSNTL | 7443 | 80.000 |
| 346 HCV 3b | 49 | 172 | 10 | B7 | MGRIsASCWL | 7444 | 40.000 |
| 347 HCV 3b | 49 | 45 | 10 | B7 | VVGSsPPMIL | 7445 | 30.000 |
| 348 HCV 3b | 49 | 102 | 10 | B7 | CVATqPPRML | 7446 | 30.000 |
| 349 HCV 3b | 49 | 181 | 10 | B7 | LALCsKPRTL | 7447 | 12.000 |
| 350 HCV 3b | 49 | 128 | 10 | B7 | KAIReATAGL | 7448 | 12.000 |
| 351 HCV 3b | 49 | 80 | 10 | B7 | PPTAaPAKPL | 7449 | 12.000 |
| 352 HCV 3b | 49 | 118 | 10 | B7 | VVRGlVTEAV | 7450 | 10.000 |
| 353 HCV 3b | 49 | 181 | 10 | B8 | LALCsKPRTL | 7451 | 16.000 |
| 354 HCV 3b | 49 | 183 | 10 | B8 | LCSKpRTLSL | 7452 | 16.000 |
| 355 HCV 3b | 49 | 66 | 10 | B_3501 | YPAStSSNTL | 7453 | 20.000 |
| 356 HCV 3b | 49 | 43 | 10 | B_3501 | SSVVgSSPPM | 7454 | 10.000 |
| 357 HCV 3b | 49 | 68 | 10 | B_3501 | ASTSsNTLPM | 7455 | 10.000 |
| 358 HCV 3b | 49 | 70 | 10 | B_3501 | TSSNtLPMPM | 7456 | 10.000 |
| 359 HCV 3b | 49 | 131 | 10 | B_4403 | REATaGLPGS | 7457 | 12.000 |
| 360 HCV 3b | 49 | 124 | 10 | B_4403 | TEAVkAIREA | 7458 | 12.000 |
| 361 HCV 3b | 50 | | | | no hits | | |
| 362 HCV 3b | 51 | 4 | 9 | A_0201 | MMYLVIGCV | 7459 | 81.705 |
| 363 HCV 3b | 51 | 3 | 9 | A_0201 | AMMYLVIGC | 7460 | 30.534 |
| 364 HCV 3b | 51 | 5 | 9 | A24 | MYLVIGCVM | 7461 | 52.500 |
| 365 HCV 3b | 51 | 3 | 10 | A_0201 | AMMYLVIGCV | 7462 | 55.572 |
| 366 HCV 3b | 51 | 6 | 10 | A_0201 | YLVIgCVMQM | 7463 | 52.561 |
| 367 HCV 3b | 52 | 12 | 10 | A_0201 | GLAFaRAQTV | 7464 | 69.552 |
| 368 HCV 3b | 53 | 5 | 9 | B_3501 | RSPGVTNRY | 7465 | 20.000 |
| 369 HCV 3b | 53 | 5 | 9 | B_4403 | RSPGVTNRY | 7466 | 10.125 |
| 370 HCV 3b | 53 | 12 | 10 | A24 | RYIPgLPRPV | 7467 | 21.600 |
| 371 HCV 3b | 53 | 16 | 10 | A3 | GLPRpVRPLR | 7468 | 18.000 |
| 372 HCV 3b | 53 | 8 | 10 | B7 | GVTNrYIPGL | 7469 | 20.000 |
| 373 HCV 3b | 54 | 17 | 9 | A3 | TLQSITVSK | 7470 | 30.000 |
| 374 HCV 3b | 54 | 22 | 10 | A_0201 | TVSKsPVYPV | 7471 | 13.997 |
| 375 HCV 3b | 54 | 23 | 10 | B_3501 | VSKSpVYPVM | 7472 | 30.000 |
| 376 HCV 3b | 54 | 9 | 10 | B_3501 | KSTYcSTATL | 7473 | 10.000 |
| 377 HCV 3b | 55 | 6 | 9 | B7 | VAVASTVSL | 7474 | 12.000 |
| 378 HCV 3b | 55 | 5 | 10 | B7 | GVAVaSTVSL | 7475 | 20.000 |
| 379 HCV 3b | 56 | 1 | 9 | B7 | MVRVPVRML | 7476 | 300.000 |
| 380 HCV 3b | 57 | 3 | 9 | B8 | VPKPRVAAT | 7477 | 16.000 |
| 381 HCV 3b | 57 | 12 | 9 | B_4403 | DGFSTRTEY | 7478 | 13.500 |
| 382 HCV 3b | 57 | 5 | 10 | B_3501 | KPRVaATDGF | 7479 | 120.000 |
| 383 HCV 3b | 57 | 11 | 10 | B_4403 | TDGFsTRTEY | 7480 | 22.500 |
| 384 HCV 3b | 58 | 40 | 9 | A_0201 | GLVLSKLAV | 7481 | 69.552 |
| 385 HCV 3b | 58 | 65 | 9 | A24 | RYRSEEPHV | 7482 | 10.000 |
| 386 HCV 3b | 58 | 45 | 9 | A3 | KLAVESPLR | 7483 | 12.000 |
| 387 HCV 3b | 58 | 33 | 9 | B7 | EPLRQDSGL | 7484 | 80.000 |
| 388 HCV 3b | 58 | 8 | 9 | B7 | TPLVHTAAL | 7485 | 80.000 |
| 389 HCV 3b | 58 | 86 | 9 | B7 | QPTRSWSTL | 7486 | 80.000 |
| 390 HCV 3b | 58 | 2 | 9 | B7 | NCRAFATPL | 7487 | 40.000 |
| 391 HCV 3b | 58 | 2 | 9 | B8 | NCRAFATPL | 7488 | 16.000 |
| 392 HCV 3b | 58 | 8 | 9 | B_3501 | TPLVHTAAL | 7489 | 20.000 |
| 393 HCV 3b | 58 | 33 | 9 | B_3501 | EPLRQDSGL | 7490 | 20.000 |
| 394 HCV 3b | 58 | 86 | 9 | B_3501 | QPTRSWSTL | 7491 | 20.000 |
| 395 HCV 3b | 58 | 58 | 9 | B_3501 | TSASRVTRY | 7492 | 10.000 |
| 396 HCV 3b | 58 | 68 | 9 | B_4403 | SEEPHVQGS | 7493 | 48.000 |
| 397 HCV 3b | 58 | 58 | 9 | B_4403 | TSASRVTRY | 7494 | 27.000 |
| 398 HCV 3b | 58 | 45 | 10 | A3 | KLAVeSPLRR | 7495 | 24.000 |
| 399 HCV 3b | 58 | 70 | 10 | B7 | EPHVqGSRDL | 7496 | 80.000 |
| 400 HCV 3b | 58 | 18 | 10 | B7 | IPTTcPEGHM | 7497 | 30.000 |
| 401 HCV 3b | 58 | 7 | 10 | B7 | ATPLvHTAAL | 7498 | 12.000 |
| 402 HCV 3b | 58 | 18 | 10 | B_3501 | IPTTcPEGHM | 7499 | 40.000 |
| 403 HCV 3b | 58 | 70 | 10 | B_3501 | EPHVqGSRDL | 7500 | 20.000 |
| 404 HCV 3b | 58 | 43 | 10 | B_3501 | LSKLaVESPL | 7501 | 15.000 |
| 405 HCV 3b | 58 | 57 | 10 | B_4403 | RTSAsRVTRY | 7502 | 13.500 |
| 406 HCV 3b | 59 | 1 | 9 | A1 | MTPPTVVPK | 7503 | 10.000 |
| 407 HCV 3b | 59 | 26 | 9 | A_0201 | FLSLPVRLV | 7504 | 147.172 |
| 408 HCV 3b | 59 | 5 | 9 | A_0201 | TVVPKKVWV | 7505 | 33.472 |
| 409 HCV 3b | 59 | 28 | 9 | A_0201 | SLPVRLVTI | 7506 | 23.995 |
| 410 HCV 3b | 59 | 10 | 9 | A_0201 | KVWVAVDST | 7507 | 21.348 |
| 411 HCV 3b | 59 | 25 | 9 | A24 | TFLSLPVRL | 7508 | 36.000 |
| 412 HCV 3b | 59 | 21 | 9 | B7 | SPVTTFLSL | 7509 | 80.000 |
| 413 HCV 3b | 59 | 52 | 9 | B7 | DSRRHPIFL | 7510 | 40.000 |
| 414 HCV 3b | 59 | 40 | 9 | B7 | SPRVCWAYA | 7511 | 20.000 |
| 415 HCV 3b | 59 | 21 | 9 | B_3501 | SPVTTFLSL | 7512 | 20.000 |
| 416 HCV 3b | 59 | 52 | 9 | B_3501 | DSRRHPIFL | 7513 | 15.000 |

TABLE 4l-continued

3b (4-6)

| No. | Strain | ORF | Start | AA | HLA | Peptide sequence | SEQ ID NO: | Score |
|---|---|---|---|---|---|---|---|---|
| 417 | HCV 3b | 59 | 7 | 9 | B_3501 | VPKKVWVAV | 7514 | 12.000 |
| 418 | HCV 3b | 59 | 39 | 9 | B_3501 | NSPRVCWAY | 7515 | 10.000 |
| 419 | HCV 3b | 59 | 37 | 9 | B_3501 | VPNSPRVCW | 7516 | 10.000 |
| 420 | HCV 3b | 59 | 1 | 10 | A1 | MTPPtVVPKK | 7517 | 10.000 |
| 421 | HCV 3b | 59 | 28 | 10 | A_0201 | SLPVrLVTIV | 7518 | 65.588 |
| 422 | HCV 3b | 59 | 6 | 10 | A_0201 | VVPKkVWVAV | 7519 | 17.588 |
| 423 | HCV 3b | 59 | 26 | 10 | A_0201 | FLSLpVRLVT | 7520 | 14.054 |
| 424 | HCV 3b | 59 | 10 | 10 | A_0201 | KVWVaVDSTC | 7521 | 12.628 |
| 425 | HCV 3b | 60 | 21 | 9 | A_0201 | KMTGSVATA | 7522 | 28.883 |
| 426 | HCV 3b | 60 | 33 | 9 | B7 | RPSAAQSCM | 7523 | 20.000 |
| 427 | HCV 3b | 60 | 33 | 9 | B_3501 | RPSAAQSCM | 7524 | 80.000 |
| 428 | HCV 3b | 60 | 39 | 9 | B_4403 | SCMGDRWSY | 7525 | 18.000 |
| 429 | HCV 3b | 60 | 14 | 10 | A_0201 | TLISiGLKMT | 7526 | 17.140 |
| 430 | HCV 3b | 60 | 6 | 10 | B7 | AVSApQVITL | 7527 | 60.000 |
| 431 | HCV 3b | 60 | 9 | 10 | B7 | APQViTLISI | 7528 | 24.000 |
| 432 | HCV 3b | 60 | 11 | 10 | B7 | QVITLISIGL | 7529 | 20.000 |
| 433 | HCV 3b | 60 | 38 | 10 | B_3501 | QSCMgDRWSY | 7530 | 15.000 |
| 434 | HCV 3b | 61 | | | | no hits | | |
| 435 | HCV 3b | 62 | 33 | 9 | A1 | AASPLHMAY | 7531 | 25.000 |
| 436 | HCV 3b | 62 | 7 | 9 | A24 | GYSRLASKI | 7532 | 66.000 |
| 437 | HCV 3b | 62 | 52 | 9 | A3 | CLYHGDKVK | 7533 | 50.000 |
| 438 | HCV 3b | 62 | 45 | 9 | B7 | QIRRPIQCL | 7534 | 60.000 |
| 439 | HCV 3b | 62 | 3 | 9 | B7 | KIREGYSRL | 7535 | 40.000 |
| 440 | HCV 3b | 62 | 20 | 9 | B7 | LPRTSRGGT | 7536 | 30.000 |
| 441 | HCV 3b | 62 | 61 | 9 | B7 | NPRSRSTPA | 7537 | 20.000 |
| 442 | HCV 3b | 62 | 12 | 9 | B7 | ASKITLSRL | 7538 | 12.000 |
| 443 | HCV 3b | 62 | 63 | 9 | B7 | RSRSTPAPM | 7539 | 10.000 |
| 444 | HCV 3b | 62 | 61 | 9 | B8 | NPRSRSTPA | 7540 | 16.000 |
| 445 | HCV 3b | 62 | 63 | 9 | B_3501 | RSRSTPAPM | 7541 | 60.000 |
| 446 | HCV 3b | 62 | 35 | 9 | B_3501 | SPLHMAYWF | 7542 | 20.000 |
| 447 | HCV 3b | 62 | 12 | 9 | B_3501 | ASKITLSRL | 7543 | 15.000 |
| 448 | HCV 3b | 62 | 3 | 9 | B_3501 | KIREGYSRL | 7544 | 12.000 |
| 449 | HCV 3b | 62 | 33 | 9 | B_4403 | AASPLHMAY | 7545 | 12.000 |
| 450 | HCV 3b | 62 | 10 | 10 | A3 | RLASkITLSR | 7546 | 12.000 |
| 451 | HCV 3b | 62 | 38 | 10 | A3 | HMAYwFHQIR | 7547 | 12.000 |
| 452 | HCV 3b | 62 | 8 | 10 | B7 | YSRLaSKITL | 7548 | 40.000 |
| 453 | HCV 3b | 62 | 69 | 10 | B7 | APMVaSSSPV | 7549 | 36.000 |
| 454 | HCV 3b | 62 | 11 | 10 | B7 | LASKiTLSRL | 7550 | 12.000 |
| 455 | HCV 3b | 62 | 8 | 10 | B_3501 | YSRLaSKITL | 7551 | 15.000 |
| 456 | HCV 3b | 62 | 32 | 10 | B_3501 | KAASpLHMAY | 7552 | 12.000 |
| 457 | HCV 3b | 63 | 3 | 9 | B_4403 | HAAQNATRY | 7553 | 13.500 |
| 458 | HCV 3b | 64 | 68 | 9 | A_0201 | TLNIEKFTV | 7554 | 403.402 |
| 459 | HCV 3b | 64 | 61 | 9 | B7 | CPPTNILTL | 7555 | 80.000 |
| 460 | HCV 3b | 64 | 44 | 9 | B7 | SQRSPLVQL | 7556 | 60.000 |
| 461 | HCV 3b | 64 | 41 | 9 | B7 | SSRSQRSPL | 7557 | 60.000 |
| 462 | HCV 3b | 64 | 61 | 9 | B_3501 | CPPTNILTL | 7558 | 20.000 |
| 463 | HCV 3b | 64 | 41 | 9 | B_3501 | SSRSQRSPL | 7559 | 15.000 |
| 464 | HCV 3b | 64 | 24 | 9 | B_4403 | SESVVEWSS | 7560 | 12.000 |
| 465 | HCV 3b | 64 | 66 | 10 | A_0201 | ILTLnIEKFT | 7561 | 69.676 |
| 466 | HCV 3b | 64 | 67 | 10 | A_0201 | LTLNiEKFTV | 7562 | 35.242 |
| 467 | HCV 3b | 64 | 43 | 10 | A24 | RSQRsPLVQL | 7563 | 12.000 |
| 468 | HCV 3b | 64 | 41 | 10 | B8 | SSRSqRSPLV | 7564 | 12.000 |
| 469 | HCV 3b | 64 | 40 | 10 | B_3501 | RSSRsQRSPL | 7565 | 10.000 |
| 470 | HCV 3b | 64 | 43 | 10 | B_3501 | RSQRsPLVQL | 7566 | 10.000 |
| 471 | HCV 3b | 65 | 1 | 9 | A_0201 | MLQGGAPQV | 7567 | 118.238 |
| 472 | HCV 3b | 65 | 6 | 9 | B7 | APQVFTNPV | 7568 | 12.000 |
| 473 | HCV 3b | 65 | 8 | 10 | A_0201 | QVFTnPVLFI | 7569 | 42.727 |
| 474 | HCV 3b | 65 | 6 | 10 | B7 | APQVfTNPVL | 7570 | 240.000 |
| 475 | HCV 3b | 65 | 20 | 10 | B7 | HPNHrPWGGL | 7571 | 120.000 |
| 476 | HCV 3b | 65 | 20 | 10 | B_3501 | HPNHrPWGGL | 7572 | 20.000 |
| 477 | HCV 3b | 65 | 6 | 10 | B_3501 | APQVfTNPVL | 7573 | 20.000 |
| 478 | HCV 3b | 65 | 30 | 10 | B_4403 | KEVNkKTSDS | 7574 | 18.000 |
| 479 | HCV 3b | 66 | | | | no hits | | |
| 480 | HCV 3b | 67 | 6 | 10 | B7 | DIRSgHPEEL | 7575 | 40.000 |
| 481 | HCV 3b | 67 | 8 | 10 | B_3501 | RSGHpEELNL | 7576 | 15.000 |
| 482 | HCV 3b | 68 | 4 | 10 | B_3501 | DPFELTNCKF | 7577 | 40.000 |
| 483 | HCV 3b | 69 | 3 | 9 | B7 | STMTTLAQL | 7578 | 12.000 |
| 484 | HCV 3b | 69 | 7 | 10 | A3 | TLAQLPCMEK | 7579 | 60.000 |
| 485 | HCV 3b | 70 | 3 | 9 | A1 | LLEQSLVSK | 7580 | 36.000 |
| 486 | HCV 3b | 70 | 1 | 9 | A_0201 | MLLLEQSLV | 7581 | 437.482 |
| 487 | HCV 3b | 70 | 39 | 9 | A_0201 | KEQPGRFPV | 7582 | 27.454 |
| 488 | HCV 3b | 70 | 11 | 9 | A24 | KYRPDAFLY | 7583 | 12.000 |
| 489 | HCV 3b | 70 | 3 | 9 | A3 | LLEQSLVSK | 7584 | 30.000 |
| 490 | HCV 3b | 70 | 9 | 9 | B_3501 | VSKYRPDAF | 7585 | 15.000 |
| 491 | HCV 3b | 70 | 4 | 9 | B_4403 | LEQSLVSKY | 7586 | 540.000 |

TABLE 4l-continued 3b (4-6)

| No. | Strain | ORF | Start | AA | HLA | Peptide sequence | SEQ ID NO: | Score |
|---|---|---|---|---|---|---|---|---|
| 492 | HCV 3b | 70 | 37 | 9 | B_4403 | IEKEQPGRF | 7587 | 40.000 |
| 493 | HCV 3b | 70 | 39 | 9 | B_4403 | KEQPGRFPV | 7588 | 12.000 |
| 494 | HCV 3b | 70 | 3 | 10 | A1 | LLEQsLVSKY | 7589 | 45.000 |
| 495 | HCV 3b | 70 | 11 | 10 | A24 | KYRPdAFLYS | 7590 | 14.400 |
| 496 | HCV 3b | 70 | 2 | 10 | A3 | LLLEqSLVSK | 7591 | 67.500 |
| 497 | HCV 3b | 70 | 3 | 10 | A3 | LLEQsLVSKY | 7592 | 12.000 |
| 498 | HCV 3b | 70 | 13 | 10 | B7 | RPDAfLYSRL | 7593 | 24.000 |
| 499 | HCV 3b | 70 | 9 | 10 | B_3501 | VSKYrPDAFL | 7594 | 15.000 |
| 500 | HCV 3b | 70 | 13 | 10 | B_3501 | RPDAfLYSRL | 7595 | 12.000 |
| 501 | HCV 3b | 71 | 15 | 9 | B7 | RVSMTLPKL | 7596 | 20.000 |
| 502 | HCV 3b | 71 | 45 | 9 | B_3501 | HPAQPQPSF | 7597 | 20.000 |
| 503 | HCV 3b | 71 | 11 | 10 | B7 | NPHVrVSMTL | 7598 | 80.000 |
| 504 | HCV 3b | 71 | 38 | 10 | B7 | EPRGgKSHPA | 7599 | 20.000 |
| 505 | HCV 3b | 71 | 5 | 10 | B7 | YPMRsANPHV | 7600 | 12.000 |
| 506 | HCV 3b | 71 | 38 | 10 | B8 | EPRGgKSHPA | 7601 | 32.000 |
| 507 | HCV 3b | 71 | 11 | 10 | B_3501 | NPHVrVSMTL | 7602 | 20.000 |
| 508 | HCV 3b | 71 | 22 | 10 | B_3501 | KLRDLRRGSF | 7603 | 12.000 |
| 509 | HCV 3b | 72 | 15 | 9 | A24 | PYQAVPQGL | 7604 | 50.400 |
| 510 | HCV 3b | 72 | 22 | 9 | A3 | GLSRPNTTR | 7605 | 18.000 |
| 511 | HCV 3b | 72 | 23 | 9 | B7 | LSRPNTTRL | 7606 | 40.000 |
| 512 | HCV 3b | 72 | 25 | 9 | B7 | RPNTTRLVI | 7607 | 12.000 |
| 513 | HCV 3b | 72 | 8 | 9 | B_3501 | LPGHSQAPY | 7608 | 40.000 |
| 514 | HCV 3b | 72 | 25 | 9 | B_3501 | RPNTTRLVI | 7609 | 16.000 |
| 515 | HCV 3b | 72 | 23 | 9 | B_3501 | LSRPNTTRL | 7610 | 15.000 |
| 516 | HCV 3b | 72 | 22 | 10 | A_0201 | GLSRpNTTRL | 7611 | 21.362 |
| 517 | HCV 3b | 72 | 14 | 10 | B7 | APYQaVPQGL | 7612 | 240.000 |
| 518 | HCV 3b | 72 | 14 | 10 | B_3501 | APYQaVPQGL | 7613 | 20.000 |

TABLE 4m

H77 (1-3)

| No. | Strain | ORF | Start | AA | HLA | Peptide sequence | SEQ ID NO: | Score |
|---|---|---|---|---|---|---|---|---|
| 1 | HCV H77 | 1 | 17 | 9 | B7 | SSRRKRLAM | 7614 | 15.000 |
| 2 | HCV H77 | 1 | 2 | 9 | B7 | GATLHHESL | 7615 | 12.000 |
| 3 | HCV H77 | 1 | 17 | 9 | B8 | SSRRKRLAM | 7616 | 20.000 |
| 4 | HCV H77 | 1 | 14 | 10 | B8 | ELLSSRRKRL | 7617 | 16.000 |
| 5 | HCV H77 | 1 | 17 | 9 | B3501 | SSRRKRLAM | 7618 | 30.000 |
| 6 | HCV H77 | 1 | 16 | 10 | B3501 | LSSRKRLAM | 7619 | 10.000 |
| 7 | HCV H77 | 1 | 15 | 9 | A0201 | LLSSRKRL | 7620 | 36.316 |
| 8 | HCV H77 | 2 | 43 | 10 | B4403 | AASPTSWGTY | 7621 | 12.000 |
| 9 | HCV H77 | 2 | 53 | 10 | B3501 | RSSAPLLEAL | 7622 | 10.000 |
| 10 | HCV H77 | 2 | 64 | 10 | B3501 | GPWRMASGFW | 7623 | 10.000 |
| 11 | HCV H77 | 2 | 64 | 9 | B3501 | GPWRMASGF | 7624 | 20.000 |
| 12 | HCV H77 | 2 | 44 | 9 | B3501 | ASPTSWGTY | 7625 | 10.000 |
| 13 | HCV H77 | 2 | 26 | 9 | B3501 | TPGVGRAIW | 7626 | 10.000 |
| 14 | HCV H77 | 2 | 5 | 10 | B7 | VAGGRDGSCL | 7627 | 12.000 |
| 15 | HCV H77 | 2 | 32 | 10 | B7 | AIWVRSSIPL | 7628 | 12.000 |
| 16 | HCV H77 | 2 | 6 | 9 | B7 | AGGRDGSCL | 7629 | 12.000 |
| 17 | HCV H77 | 2 | 51 | 9 | A24 | TYRSSAPLL | 7630 | 200.000 |
| 18 | HCV H77 | 2 | 12 | 9 | A24 | SCLPVALGL | 7631 | 10.080 |
| 19 | HCV H77 | 2 | 32 | 10 | A0201 | AIWVRSSIPL | 7632 | 24.380 |
| 20 | HCV H77 | 2 | 67 | 10 | A0201 | RMASGFWKTA | 7633 | 23.178 |
| 21 | HCV H77 | 2 | 67 | 9 | A0201 | RMASGFWKT | 7634 | 76.695 |
| 22 | HCV H77 | 2 | 58 | 10 | A1 | LLEALPGPWR | 7635 | 18.000 |
| 23 | HCV H77 | 3 | 2 | 9 | A0201 | QQGTFLVAL | 7636 | 18.930 |
| 24 | HCV H77 | 4 | 2 | 10 | B3501 | SPMIALTRVL | 7637 | 20.000 |
| 25 | HCV H77 | 4 | 19 | 9 | B8 | SCTLRGVSL | 7638 | 16.000 |
| 26 | HCV H77 | 4 | 2 | 10 | B7 | SPMIALTRVL | 7639 | 240.000 |
| 27 | HCV H77 | 4 | 2 | 9 | B7 | SPMIALTRV | 7640 | 12.000 |
| 28 | HCV H77 | 4 | 26 | 10 | A3 | SLAFARVTPR | 7641 | 12.000 |
| 29 | HCV H77 | 4 | 24 | 9 | A0201 | GVSLAFARV | 7642 | 11.563 |
| 30 | HCV H77 | 5 | 4 | 10 | B3501 | APRLGLLVSL | 7643 | 60.000 |
| 31 | HCV H77 | 5 | 1 | 10 | B3501 | MPAAPRLGLL | 7644 | 20.000 |
| 32 | HCV H77 | 5 | 1 | 10 | B8 | MPAAPRLGLL | 7645 | 16.000 |
| 33 | HCV H77 | 5 | 4 | 10 | B8 | APRLGLLVSL | 7646 | 16.000 |
| 34 | HCV H77 | 5 | 4 | 10 | B7 | APRLGLLVSL | 7647 | 240.000 |
| 35 | HCV H77 | 5 | 1 | 10 | B7 | MPAAPRLGLL | 7648 | 80.000 |
| 36 | HCV H77 | 5 | 8 | 9 | A0201 | GLLVSLHQA | 7649 | 42.278 |
| 37 | HCV H77 | 7 | 24 | 10 | B3501 | CPQRACVARY | 7650 | 40.000 |
| 38 | HCV H77 | 7 | 28 | 10 | B7 | ACVARYIASL | 7651 | 12.000 |

TABLE 4m-continued

H77 (1-3)

| No. | Strain | ORF | Start | AA | HLA | Peptide sequence | SEQ ID NO: | Score |
|---|---|---|---|---|---|---|---|---|
| 39 | HCV H77 | 7 | 57 | 10 | B7 | VQMIRMSSSL | 7652 | 12.000 |
| 40 | HCV H77 | 7 | 29 | 9 | B7 | CVARYIASL | 7653 | 20.000 |
| 41 | HCV H77 | 7 | 12 | 9 | B7 | TAGTTLQDL | 7654 | 12.000 |
| 42 | HCV H77 | 7 | 9 | 9 | B7 | NAPTAGTTL | 7655 | 12.000 |
| 43 | HCV H77 | 7 | 36 | 10 | A3 | SLPAPWWWER | 7656 | 36.000 |
| 44 | HCV H77 | 7 | 32 | 10 | A24 | RYIALPAPW | 7657 | 18.000 |
| 45 | HCV H77 | 7 | 51 | 10 | A0201 | RLPTAGVQMI | 7658 | 23.995 |
| 46 | HCV H77 | 7 | 57 | 10 | A0201 | VQMIRMSSSL | 7659 | 13.624 |
| 47 | HCV H77 | 7 | 22 | 9 | A0201 | ALCPQRACV | 7660 | 69.552 |
| 48 | HCV H77 | 7 | 16 | 9 | A0201 | TLQDLVALC | 7661 | 46.848 |
| 49 | HCV H77 | 7 | 58 | 9 | A0201 | QMIRMSSSL | 7662 | 15.428 |
| 50 | HCV H77 | 8 | 3 | 9 | B3501 | HPWPGRTVL | 7663 | 20.000 |
| 51 | HCV H77 | 8 | 12 | 9 | B3501 | CPSSCSSAL | 7664 | 20.000 |
| 52 | HCV H77 | 10 | 61 | 10 | A24 | RYCLGQFTEW | 7665 | 11.000 |
| 53 | HCV H77 | 10 | 13 | 10 | A24 | RTTACEIWPL | 7666 | 8.000 |
| 54 | HCV H77 | 10 | 2 | 10 | A0201 | CITISPLFET | 7667 | 13.669 |
| 55 | HCV H77 | 10 | 9 | 9 | B4403 | FETGRTTAC | 7668 | 13.500 |
| 56 | HCV H77 | 10 | 17 | 10 | B4403 | CEIWPLWNQS | 7669 | 20.000 |
| 57 | HCV H77 | 10 | 55 | 10 | B3501 | LPVGARRYCL | 7670 | 20.000 |
| 58 | HCV H77 | 10 | 32 | 10 | B3501 | RPSSSRGGQI | 7671 | 16.000 |
| 59 | HCV H77 | 10 | 55 | 10 | B8 | LPVGARRYCL | 7672 | 16.000 |
| 60 | HCV H77 | 10 | 55 | 10 | B7 | LPVGARRYCL | 7673 | 120.000 |
| 61 | HCV H77 | 11 | 33 | 10 | A0201 | TLWAGPLLKV | 7674 | 1.327.748 |
| 62 | HCV H77 | 11 | 32 | 10 | A24 | KTLWAGPLL | 7675 | 12.000 |
| 63 | HCV H77 | 11 | 25 | 10 | A24 | RCIPMWTKTL | 7676 | 14.400 |
| 64 | HCV H77 | 11 | 13 | 10 | A24 | RGPSHHPRVL | 7677 | 12.000 |
| 65 | HCV H77 | 11 | 33 | 9 | A3 | TLWAGPLLK | 7678 | 200.000 |
| 66 | HCV H77 | 11 | 5 | 9 | A3 | GLSTTGPER | 7679 | 12.000 |
| 67 | HCV H77 | 11 | 14 | 9 | B7 | GPSHHPRVL | 7680 | 80.000 |
| 68 | HCV H77 | 11 | 18 | 9 | B7 | HPRVLSSRC | 7681 | 20.000 |
| 69 | HCV H77 | 11 | 18 | 10 | B7 | HPRVLSSRCI | 7682 | 80.000 |
| 70 | HCV H77 | 11 | 14 | 9 | B3501 | GPSHHPRVL | 7683 | 20.000 |
| 71 | HCV H77 | 11 | 27 | 9 | B3501 | IPMWTKTLW | 7684 | 10.000 |
| 72 | HCV H77 | 11 | 18 | 10 | B3501 | HPRVLSSRCI | 7685 | 24.000 |
| 73 | HCV H77 | 12 | 7 | 9 | B4403 | GEVIAGVAC | 7686 | 18.000 |
| 74 | HCV H77 | 12 | 7 | 10 | B4403 | GEVIAGVACF | 7687 | 360.000 |
| 75 | HCV H77 | 13 | 40 | 10 | B3501 | CPRPMGLILI | 7688 | 24.000 |
| 76 | HCV H77 | 13 | 27 | 10 | B3501 | TPLLLQRWAL | 7689 | 20.000 |
| 77 | HCV H77 | 13 | 40 | 9 | B3501 | CPRPMGLIL | 7690 | 60.000 |
| 78 | HCV H77 | 13 | 40 | 9 | B8 | CPRPMGLIL | 7691 | 16.000 |
| 79 | HCV H77 | 13 | 27 | 10 | B7 | TPLLLQRWAL | 7692 | 120.000 |
| 80 | HCV H77 | 13 | 20 | 10 | B7 | ATRCWCSTPL | 7693 | 120.000 |
| 81 | HCV H77 | 13 | 5 | 10 | B7 | AAVRAPRSRL | 7694 | 81.000 |
| 82 | HCV H77 | 13 | 40 | 10 | B7 | CPRPMGLILI | 7695 | 80.000 |
| 83 | HCV H77 | 13 | 6 | 9 | B7 | AVRAPRSRL | 7696 | 1.350.000 |
| 84 | HCV H77 | 13 | 40 | 9 | B7 | CPRPMGLIL | 7697 | 800.000 |
| 85 | HCV H77 | 13 | 17 | 9 | B7 | QPRATRCWC | 7698 | 30.000 |
| 86 | HCV H77 | 13 | 29 | 10 | A0201 | LLLQRWALVL | 7699 | 55.091 |
| 87 | HCV H77 | 13 | 37 | 10 | A0201 | VLTCPRPMGL | 7700 | 36.316 |
| 88 | HCV H77 | 13 | 30 | 10 | A0201 | LLQRWALVLT | 7701 | 29.137 |
| 89 | HCV H77 | 13 | 29 | 9 | A0201 | LLLQRWALV | 7702 | 743.720 |
| 90 | HCV H77 | 13 | 30 | 9 | A0201 | LLQRWALVL | 7703 | 14.890 |
| 91 | HCV H77 | 13 | 28 | 9 | A0201 | PLLLQRWAL | 7704 | 13.042 |
| 92 | HCV H77 | 14 | 22 | 9 | A0201 | WLCSPLLPL | 7705 | 226.014 |
| 93 | HCV H77 | 14 | 27 | 9 | A0201 | LLPLRAPSL | 7706 | 36.316 |
| 94 | HCV H77 | 14 | 9 | 9 | A0201 | ALSLTKQRL | 7707 | 21.362 |
| 95 | HCV H77 | 14 | 31 | 9 | A24 | RAPSLCPIL | 7708 | 14.400 |
| 96 | HCV H77 | 14 | 1 | 10 | B3501 | MPHPSWASAL | 7709 | 20.000 |
| 97 | HCV H77 | 14 | 3 | 10 | B3501 | HPSWASALSL | 7710 | 20.000 |
| 98 | HCV H77 | 14 | 36 | 10 | B3501 | CPILTSRRLL | 7711 | 20.000 |
| 99 | HCV H77 | 14 | 18 | 10 | B3501 | RGRDWLCSPL | 7712 | 12.000 |
| 100 | HCV H77 | 14 | 46 | 9 | B3501 | CPPPERSPF | 7713 | 30.000 |
| 101 | HCV H77 | 14 | 36 | 9 | B3501 | CPILTSRRL | 7714 | 20.000 |
| 102 | HCV H77 | 14 | 36 | 10 | B7 | CPILTSRRLL | 7715 | 120.000 |
| 103 | HCV H77 | 14 | 1 | 10 | B7 | MPHPSWASAL | 7716 | 80.000 |
| 104 | HCV H77 | 14 | 3 | 10 | B7 | HPSWASALSL | 7717 | 80.000 |
| 105 | HCV H77 | 14 | 14 | 10 | B7 | KQRLRGRDWL | 7718 | 60.000 |
| 106 | HCV H77 | 14 | 18 | 10 | B7 | RGRDWLCSPL | 7719 | 40.000 |
| 107 | HCV H77 | 14 | 8 | 10 | B7 | SALSLTKQRL | 7720 | 12.000 |
| 108 | HCV H77 | 14 | 36 | 9 | B7 | CPILTSRRL | 7721 | 80.000 |
| 109 | HCV H77 | 14 | 31 | 9 | B7 | RAPSLCPIL | 7722 | 12.000 |
| 110 | HCV H77 | 14 | 9 | 9 | B7 | ALSLTKQRL | 7723 | 12.000 |
| 111 | HCV H77 | 14 | 34 | 9 | A3 | SLCPILTSR | 7724 | 13.500 |
| 112 | HCV H77 | 14 | 18 | 10 | A24 | RGRDWLCSPL | 7725 | 11.520 |
| 113 | HCV H77 | 15 | 3 | 10 | B7 | WPTTAVLTCL | 7726 | 80.000 |

TABLE 4m-continued

H77 (1-3)

| No. Strain | ORF | Start | AA | HLA | Peptide sequence | SEQ ID NO: | Score |
|---|---|---|---|---|---|---|---|
| 114 HCV H77 | 15 | 17 | 10 | B7 | AAMLSSCRPM | 7727 | 27.000 |
| 115 HCV H77 | 15 | 18 | 10 | B7 | AMLSSCRPML | 7728 | 18.000 |
| 116 HCV H77 | 15 | 1 | 9 | B3501 | MPWPTTAVL | 7729 | 20.000 |
| 117 HCV H77 | 15 | 3 | 10 | B3501 | WPTTAVLTCL | 7730 | 20.000 |
| 118 HCV H77 | 15 | 1 | 9 | B7 | MPWPTTAVL | 7731 | 80.000 |
| 119 HCV H77 | 15 | 18 | 10 | A0201 | AMLSSCRPML | 7732 | 57.085 |
| 120 HCV H77 | 15 | 11 | 10 | A0201 | CLSSRPAAML | 7733 | 21.362 |
| 121 HCV H77 | 15 | 19 | 9 | A0201 | MLSSCRPML | 7734 | 36.316 |
| 122 HCV H77 | 16 | 3 | 10 | B3501 | SPGLNAGAGL | 7735 | 20.000 |
| 123 HCV H77 | 16 | 52 | 9 | B3501 | RPPRLQLGY | 7736 | 80.000 |
| 124 HCV H77 | 16 | 3 | 10 | B7 | SPGLNAGAGL | 7737 | 80.000 |
| 125 HCV H77 | 16 | 38 | 10 | B7 | SVSAMTRAVL | 7738 | 30.000 |
| 126 HCV H77 | 16 | 47 | 10 | B7 | LGMSSRPPRL | 7739 | 12.000 |
| 127 HCV H77 | 16 | 13 | 10 | B7 | AGGSQASIDL | 7740 | 12.000 |
| 128 HCV H77 | 16 | 33 | 10 | B7 | STRPSSVSAM | 7741 | 10.000 |
| 129 HCV H77 | 16 | 50 | 9 | B7 | SSRPPRLQL | 7742 | 90.000 |
| 130 HCV H77 | 16 | 11 | 10 | A0201 | GLAGGSQASI | 7743 | 10.433 |
| 131 HCV H77 | 16 | 48 | 9 | A0201 | GMSSRPPRL | 7744 | 15.428 |
| 132 HCV H77 | 17 | 8 | 9 | B3501 | QSRVGRTFL | 7745 | 15.000 |
| 133 HCV H77 | 17 | 5 | 10 | B7 | YPRQSRVGRT | 7746 | 20.000 |
| 134 HCV H77 | 17 | 8 | 9 | B7 | QSRVGRTFL | 7747 | 60.000 |
| 135 HCV H77 | 17 | 7 | 10 | A0201 | RQSRVGRTFL | 7748 | 11.913 |
| 136 HCV H77 | 18 | 4 | 10 | B3501 | HPCYTDWALF | 7749 | 30.000 |
| 137 HCV H77 | 18 | 4 | 9 | B3501 | HPCYTDWAL | 7750 | 20.000 |
| 138 HCV H77 | 18 | 4 | 9 | B7 | HPCYTDWAL | 7751 | 80.000 |
| 139 HCV H77 | 18 | 6 | 10 | A24 | CYTDWALFRM | 7752 | 30.000 |
| 140 HCV H77 | 18 | 7 | 10 | A1 | YTDWALFRMK | 7753 | 25.000 |
| 141 HCV H77 | 19 | 6 | 10 | A3 | ALSTYRTSSK | 7754 | 20.000 |
| 142 HCV H77 | 20 | 39 | 9 | A24 | RCLVTPPLL | 7755 | 12.000 |
| 143 HCV H77 | 20 | 37 | 10 | B7 | CQRCLVTPPL | 7756 | 40.000 |
| 144 HCV H77 | 20 | 10 | 10 | B3501 | RPTGRNSRSF | 7757 | 40.000 |
| 145 HCV H77 | 21 | 2 | 9 | B7 | MARAWRELL | 7758 | 180.000 |
| 146 HCV H77 | 21 | 2 | 9 | B8 | MARAWRELL | 7759 | 16.000 |
| 147 HCV H77 | 22 | 11 | 10 | A1 | AMQPPASLPY | 7760 | 12.500 |
| 148 HCV H77 | 22 | 17 | 9 | A1 | SLPYSAASL | 7761 | 21.362 |
| 149 HCV H77 | 22 | 10 | 9 | A24 | RAMQPPASL | 7762 | 12.000 |
| 150 HCV H77 | 22 | 11 | 10 | A3 | AMQPPASLPY | 7763 | 12.000 |
| 151 HCV H77 | 22 | 10 | 9 | B7 | RAMQPPASL | 7764 | 54.000 |
| 152 HCV H77 | 22 | 3 | 10 | B7 | PPRTTCRRAM | 7765 | 30.000 |
| 153 HCV H77 | 22 | 16 | 10 | B7 | ASLPYSAASL | 7766 | 12.000 |
| 154 HCV H77 | 22 | 3 | 10 | B3501 | PPRTTCRRAM | 7767 | 12.000 |
| 155 HCV H77 | 24 | 6 | 10 | A24 | PYLQKFCGSL | 7768 | 30.000 |
| 156 HCV H77 | 24 | 7 | 9 | A0201 | YLQKFCGSL | 7769 | 48.544 |
| 157 HCV H77 | 25 | 96 | 10 | B3501 | RSVVGPTPKM | 7770 | 20.000 |
| 158 HCV H77 | 25 | 27 | 10 | B3501 | QPYLLPWPSL | 7771 | 20.000 |
| 159 HCV H77 | 25 | 75 | 10 | B3501 | LPCPPWRGSL | 7772 | 20.000 |
| 160 HCV H77 | 25 | 24 | 10 | B3501 | SPNQPYLLPW | 7773 | 10.000 |
| 161 HCV H77 | 25 | 33 | 9 | B3501 | WPSLPPKVL | 7774 | 20.000 |
| 162 HCV H77 | 25 | 72 | 9 | B3501 | SPILPCPPW | 7775 | 10.000 |
| 163 HCV H77 | 25 | 2 | 10 | B8 | AARYHLHGPL | 7776 | 16.000 |
| 164 HCV H77 | 25 | 2 | 10 | B7 | AARYHLHGPL | 7777 | 360.000 |
| 165 HCV H77 | 25 | 75 | 10 | B7 | LPCPPWRGSL | 7778 | 120.000 |
| 166 HCV H77 | 25 | 27 | 10 | B7 | QPYLLPWPSL | 7779 | 120.000 |
| 167 HCV H77 | 25 | 65 | 10 | B7 | APPTPTLSPI | 7780 | 24.000 |
| 168 HCV H77 | 25 | 33 | 9 | B7 | WPSLPPKVL | 7781 | 120.000 |
| 169 HCV H77 | 25 | 63 | 9 | B7 | LAAPPTPTL | 7782 | 18.000 |
| 170 HCV H77 | 25 | 116 | 9 | B7 | QAHSSPRAL | 7783 | 12.000 |
| 171 HCV H77 | 25 | 41 | 9 | B7 | LAAPQLPAL | 7784 | 12.000 |
| 172 HCV H77 | 25 | 50 | 9 | B7 | RATIRQHPL | 7785 | 12.000 |
| 173 HCV H77 | 25 | 30 | 10 | A3 | LLPWPSLPPK | 7786 | 30.000 |
| 174 HCV H77 | 25 | 4 | 10 | A24 | RYHLHGPLLC | 7787 | 10.000 |
| 175 HCV H77 | 25 | 4 | 9 | A24 | RYHLHGPLL | 7788 | 400.000 |
| 176 HCV H77 | 25 | 28 | 9 | A24 | PYLLPWPSL | 7789 | 30.000 |
| 177 HCV H77 | 25 | 54 | 9 | A24 | RQHPLSPPL | 7790 | 11.520 |
| 178 HCV H77 | 25 | 11 | 10 | A0201 | LLCLRLGKSV | 7791 | 118.238 |
| 179 HCV H77 | 25 | 40 | 10 | A0201 | VLAAPQLPAL | 7792 | 83.527 |
| 180 HCV H77 | 25 | 62 | 10 | A0201 | LLAAPPTPTL | 7793 | 36.316 |
| 181 HCV H77 | 25 | 104 | 10 | A0201 | KMSCAAQCLI | 7794 | 26.372 |
| 182 HCV H77 | 25 | 104 | 9 | A0201 | KMSCAAQCL | 7795 | 53.999 |
| 183 HCV H77 | 25 | 83 | 9 | A0201 | SLGIRISAT | 7796 | 17.140 |
| 184 HCV H77 | 25 | 62 | 9 | A0201 | LLAAPPTPT | 7797 | 12.668 |
| 185 HCV H77 | 25 | 35 | 9 | A0201 | SLPPKVLAA | 7798 | 11.426 |
| 186 HCV H77 | 25 | 45 | 9 | A0201 | QLPALRATI | 7799 | 10.433 |
| 187 HCV H77 | 25 | 118 | 9 | A1 | HSSPRALRK | 7800 | 15.000 |
| 188 HCV H77 | 27 | 57 | 10 | B4403 | ATAGAARAAY | 7801 | 27.000 |

TABLE 4m-continued

H77 (1-3)

| No. Strain | ORF | Start | AA | HLA | Peptide sequence | SEQ ID NO: | Score |
|---|---|---|---|---|---|---|---|
| 189 HCV H77 | 27 | 30 | 10 | B3501 | KPAWPSSLSL | 7802 | 40.000 |
| 190 HCV H77 | 27 | 33 | 10 | B3501 | WPSSPSLRGF | 7803 | 20.000 |
| 191 HCV H77 | 27 | 36 | 9 | B3501 | SPSLRGFML | 7804 | 20.000 |
| 192 HCV H77 | 27 | 35 | 9 | B3501 | SSPSLRGFM | 7805 | 10.000 |
| 193 HCV H77 | 27 | 36 | 9 | B8 | SPSLRGFML | 7806 | 16.000 |
| 194 HCV H77 | 27 | 2 | 10 | B7 | IPAVLTPQSL | 7807 | 80.000 |
| 195 HCV H77 | 27 | 30 | 10 | B7 | KPAWPSSLSL | 7808 | 80.000 |
| 196 HCV H77 | 27 | 38 | 10 | B7 | SLRGFMLGAL | 7809 | 40.000 |
| 197 HCV H77 | 27 | 15 | 10 | B7 | SVRRRQFTNV | 7810 | 10.000 |
| 198 HCV H77 | 27 | 36 | 9 | B7 | SPSLRGFML | 7811 | 80.000 |
| 199 HCV H77 | 27 | 46 | 9 | A3 | ALLPIQGGK | 7812 | 20.000 |
| 200 HCV H77 | 27 | 19 | 10 | A0201 | RQFTNVVTWT | 7813 | 35.364 |
| 201 HCV H77 | 27 | 42 | 9 | A0201 | FMLGALLPI | 7814 | 294.957 |
| 202 HCV H77 | 28 | 48 | 9 | B4403 | EEAGLPYVA | 7815 | 12.000 |
| 203 HCV H77 | 28 | 31 | 10 | B4403 | CELGDTGPGA | 7816 | 12.000 |
| 204 HCV H77 | 28 | 48 | 10 | B4403 | EEAGLPYVAS | 7817 | 12.000 |
| 205 HCV H77 | 28 | 46 | 9 | B3501 | CPEEAGLPY | 7818 | 24.000 |
| 206 HCV H77 | 28 | 37 | 9 | B3501 | GPGASALGF | 7819 | 20.000 |
| 207 HCV H77 | 28 | 3 | 10 | B7 | SAHFHSTVTL | 7820 | 12.000 |
| 208 HCV H77 | 28 | 44 | 9 | A24 | GFCPEEAGL | 7821 | 24.000 |
| 209 HCV H77 | 28 | 25 | 9 | A0201 | NLGSRPCEL | 7822 | 21.362 |
| 210 HCV H77 | 28 | 46 | 9 | A1 | CPEEAGLPY | 7823 | 56.250 |
| 211 HCV H77 | 29 | 3 | 9 | B4403 | GPAGSGFAY | 7824 | 13.500 |
| 212 HCV H77 | 29 | 3 | 9 | B3501 | GPAGSGFAY | 7825 | 40.000 |
| 213 HCV H77 | 29 | 1 | 9 | B3501 | MPGPAGSGF | 7826 | 20.000 |
| 214 HCV H77 | 33 | 47 | 10 | B4403 | GELGEGPGSA | 7827 | 12.000 |
| 215 HCV H77 | 33 | 50 | 10 | B4403 | GEGPGSAAAI | 7828 | 12.000 |
| 216 HCV H77 | 33 | 5 | 9 | B4403 | DELVPYGSV | 7829 | 24.000 |
| 217 HCV H77 | 33 | 47 | 9 | B4403 | GELGEGPGS | 7830 | 12.000 |
| 218 HCV H77 | 33 | 92 | 10 | B3501 | HPTDQHRQL | 7831 | 40.000 |
| 219 HCV H77 | 33 | 74 | 9 | B3501 | RPHHGWACW | 7832 | 20.000 |
| 220 HCV H77 | 33 | 36 | 9 | B3501 | SPGGHSVFL | 7833 | 20.000 |
| 221 HCV H77 | 33 | 92 | 10 | B7 | HPTDQHRQL | 7834 | 80.000 |
| 222 HCV H77 | 33 | 36 | 9 | B7 | SPGGHSVFL | 7835 | 80.000 |
| 223 HCV H77 | 33 | 41 | 9 | B7 | SVFLHGGEL | 7836 | 20.000 |
| 224 HCV H77 | 33 | 33 | 10 | A0201 | SLGSPGGHSV | 7837 | 69.552 |
| 225 HCV H77 | 34 | 37 | 10 | B3501 | SSRFPLIDTL | 7838 | 15.000 |
| 226 HCV H77 | 34 | 40 | 9 | B3501 | FPLIDTLYL | 7839 | 30.000 |
| 227 HCV H77 | 34 | 34 | 10 | B8 | LARSSRFPLI | 7840 | 80.000 |
| 228 HCV H77 | 34 | 26 | 9 | B8 | QCGPRPCGL | 7841 | 16.000 |
| 229 HCV H77 | 34 | 34 | 9 | B8 | LARSSRFPL | 7842 | 16.000 |
| 230 HCV H77 | 34 | 37 | 10 | B7 | SSRFPLIDTL | 7843 | 40.000 |
| 231 HCV H77 | 34 | 34 | 10 | B7 | LARSSRFPLI | 7844 | 12.000 |
| 232 HCV H77 | 34 | 34 | 9 | B7 | LARSSRFPL | 7845 | 180.000 |
| 233 HCV H77 | 34 | 40 | 9 | B7 | FPLIDTLYL | 7846 | 80.000 |
| 234 HCV H77 | 34 | 39 | 10 | A24 | RFPLIDTLYL | 7847 | 60.000 |
| 235 HCV H77 | 34 | 46 | 9 | A24 | LYLRLLGPL | 7848 | 360.000 |
| 236 HCV H77 | 34 | 33 | 10 | A0201 | GLARSSRFPL | 7849 | 193.902 |
| 237 HCV H77 | 34 | 45 | 10 | A0201 | TLYLRLLGPL | 7850 | 20.440 |
| 238 HCV H77 | 34 | 40 | 9 | A0201 | FPLIDTLYL | 7851 | 13.054 |
| 239 HCV H77 | 35 | 14 | 9 | B8 | GARWRRPGC | 7852 | 16.000 |
| 240 HCV H77 | 35 | 23 | 10 | B7 | SGRVLPVNRL | 7853 | 60.000 |
| 241 HCV H77 | 35 | 5 | 9 | B7 | RPGGRHEHL | 7854 | 80.000 |
| 242 HCV H77 | 35 | 19 | 9 | B7 | RPGCSGRVL | 7855 | 80.000 |
| 243 HCV H77 | 35 | 40 | 10 | A0201 | RLVREAGNYT | 7856 | 40.986 |
| 244 HCV H77 | 36 | 47 | 9 | B4403 | ASVDKLGVY | 7857 | 27.000 |
| 245 HCV H77 | 36 | 2 | 9 | B4403 | DEPANSLRL | 7858 | 12.000 |
| 246 HCV H77 | 36 | 62 | 10 | B3501 | LAKGHLGLDM | 7859 | 18.000 |
| 247 HCV H77 | 36 | 47 | 9 | B3501 | ASVDKLGVY | 7860 | 20.000 |
| 248 HCV H77 | 36 | 58 | 10 | B7 | MLRFLAKGHL | 7861 | 40.000 |
| 249 HCV H77 | 36 | 53 | 10 | B7 | GVYHSMLRFL | 7862 | 20.000 |
| 250 HCV H77 | 36 | 44 | 9 | B7 | EATASVDKL | 7863 | 12.000 |
| 251 HCV H77 | 36 | 51 | 10 | A3 | KLGVYHSMLR | 7864 | 24.000 |
| 252 HCV H77 | 36 | 68 | 9 | A3 | GLDMRGAER | 7865 | 12.000 |
| 253 HCV H77 | 36 | 60 | 10 | A24 | RFLAKGHLGL | 7866 | 60.000 |
| 254 HCV H77 | 36 | 54 | 9 | A24 | VYHSMLRFL | 7867 | 200.000 |
| 255 HCV H77 | 36 | 53 | 10 | A0201 | GVYHSMLRFL | 7868 | 15.133 |
| 256 HCV H77 | 36 | 61 | 9 | A0201 | FLAKGHLGL | 7869 | 98.267 |
| 257 HCV H77 | 36 | 51 | 9 | A0201 | KLGVYHSML | 7870 | 74.768 |
| 258 HCV H77 | 36 | 68 | 9 | A1 | GLDMRGAER | 7871 | 10.000 |
| 259 HCV H77 | 36 | 5 | 9 | B3501 | RPGGRHEHL | 7872 | 40.000 |
| 260 HCV H77 | 36 | 19 | 9 | B3501 | RPGCSGRVL | 7873 | 40.000 |
| 261 HCV H77 | 37 | 40 | 10 | B3501 | TPRVPGGVAI | 7874 | 24.000 |
| 262 HCV H77 | 37 | 18 | 9 | B3501 | APTQVCAPL | 7875 | 20.000 |
| 263 HCV H77 | 37 | 43 | 9 | B3501 | VPGGVAITL | 7876 | 20.000 |

TABLE 4m-continued

H77 (1-3)

| No. | Strain | ORF | Start | AA | HLA | Peptide sequence | SEQ ID NO: | Score |
|---|---|---|---|---|---|---|---|---|
| 264 | HCV H77 | 37 | 40 | 10 | B7 | TPRVPGGVAI | 7877 | 80.000 |
| 265 | HCV H77 | 37 | 42 | 10 | B7 | RVPGGVAITL | 7878 | 20.000 |
| 266 | HCV H77 | 37 | 1 | 10 | B7 | MPVPDPIARI | 7879 | 12.000 |
| 267 | HCV H77 | 37 | 17 | 10 | B7 | GAPTQVCAPL | 7880 | 12.000 |
| 268 | HCV H77 | 37 | 18 | 9 | B7 | APTQVCAPL | 7881 | 240.000 |
| 269 | HCV H77 | 37 | 43 | 9 | B7 | VPGGVAITL | 7882 | 80.000 |
| 270 | HCV H77 | 37 | 21 | 9 | B7 | QVCAPLQAL | 7883 | 30.000 |
| 271 | HCV H77 | 37 | 40 | 9 | B7 | TPRVPGGVA | 7884 | 30.000 |
| 272 | HCV H77 | 37 | 42 | 10 | A24 | RVPGGVAITL | 7885 | 16.800 |
| 273 | HCV H77 | 37 | 35 | 9 | A0201 | IIQSRTPRV | 7886 | 16.258 |
| 274 | HCV H77 | 37 | 3 | 9 | A1 | VPDPIARIF | 7887 | 12.500 |
| 275 | HCV H77 | 38 | 8 | 10 | B7 | RPRRRWKEGL | 7888 | 800.000 |
| 276 | HCV H77 | 38 | 8 | 10 | B3501 | RPRRRWKEGL | 7889 | 120.000 |
| 277 | HCV H77 | 39 | 1 | 10 | B3501 | MPQKTWGPAL | 7890 | 20.000 |
| 278 | HCV H77 | 39 | 12 | 9 | A1 | SLETPGPER | 7891 | 18.000 |
| 279 | HCV H77 | 39 | 4 | 10 | A0201 | KTWGPALASL | 7892 | 19.824 |
| 280 | HCV H77 | 39 | 1 | 10 | B7 | MPQKTWGPAL | 7893 | 80.000 |
| 281 | HCV H77 | 40 | 47 | 9 | B3501 | CPAPLVLVL | 7894 | 20.000 |
| 282 | HCV H77 | 40 | 57 | 10 | B3501 | TPARCRGRHL | 7895 | 20.000 |
| 283 | HCV H77 | 40 | 57 | 10 | B8 | TPARCRGRHL | 7896 | 16.000 |
| 284 | HCV H77 | 40 | 58 | 9 | B8 | PARCRGRHL | 7897 | 32.000 |
| 285 | HCV H77 | 40 | 57 | 10 | B7 | TPARCRGRHL | 7898 | 80.000 |
| 286 | HCV H77 | 40 | 42 | 10 | B7 | SQRVSCPAPL | 7899 | 40.000 |
| 287 | HCV H77 | 40 | 44 | 10 | B7 | RVSCPAPLVL | 7900 | 20.000 |
| 288 | HCV H77 | 40 | 27 | 9 | B7 | LVRLVHGWL | 7901 | 200.000 |
| 289 | HCV H77 | 40 | 47 | 9 | B7 | CPAPLVLVL | 7902 | 80.000 |
| 290 | HCV H77 | 40 | 58 | 9 | B7 | PARCRGRHL | 7903 | 12.000 |
| 291 | HCV H77 | 40 | 65 | 9 | A3 | HLPPPQPMK | 7904 | 45.000 |
| 292 | HCV H77 | 40 | 29 | 9 | A3 | RLVHGWLQR | 7905 | 12.000 |
| 293 | HCV H77 | 40 | 22 | 9 | A24 | RWPAGLVRL | 7906 | 12.000 |
| 294 | HCV H77 | 40 | 26 | 10 | A0201 | GLVRLVHGWL | 7907 | 15.274 |

TABLE 4n

H77 (4-6)

| No | Strain | ORF | HLA | Start | Sequence | SEQ ID NO: | Score |
|---|---|---|---|---|---|---|---|
| 1 | HCV H77 | 1 | B4403 | 4 | REASISTLC | 7908 | 12 |
| 2 | HCV H77 | 1 | B4403 | 4 | REASISTLCS | 7909 | 12 |
| 3 | HCV H77 | 1 | B7 | 2 | ICREASISTL | 7910 | 40 |
| 4 | HCV H77 | 1 | B8 | 2 | ICREASISTL | 7911 | 24 |
| 5 | HCV H77 | 2 | B7 | 16 | CVGAPRPIL | 7912 | 45 |
| 6 | HCV H77 | 2 | B8 | 6 | AARACKGAQT | 7913 | 16 |
| 7 | HCV H77 | 3 | B7 | 11 | DAVASGAGL | 7914 | 12 |
| 8 | HCV H77 | 4 | A68.1 | 22 | PVQRCRWRR | 7915 | 20 |
| 9 | HCV H77 | 4 | A68.1 | 21 | SPVQRCRWR | 7916 | 10 |
| 10 | HCV H77 | 4 | A68.1 | 30 | RQLGQHPQR | 7917 | 10 |
| 11 | HCV H77 | 4 | A68.1 | 21 | SPVQRCRWRR | 7918 | 10 |
| 12 | HCV H77 | 4 | B3501 | 5 | LPPRPRHTL | 7919 | 20 |
| 13 | HCV H77 | 4 | B3501 | 8 | RPRHTLQEC | 7920 | 12 |
| 14 | HCV H77 | 4 | B3501 | 19 | GPSPVQRCRW | 7921 | 10 |
| 15 | HCV H77 | 4 | B4403 | 3 | QELPPRPRHT | 7922 | 16 |
| 16 | HCV H77 | 4 | B7 | 5 | LPPRPRHTL | 7923 | 180 |
| 17 | HCV H77 | 4 | B7 | 8 | RPRHTLQEC | 7924 | 20 |
| 18 | HCV H77 | 4 | B7 | 23 | VQRCRWRRQL | 7925 | 60 |
| 19 | HCV H77 | 5 | A0201 | 10 | ALTGPPSIV | 7926 | 28.52 |
| 20 | HCV H77 | 5 | A0201 | 2 | KQWRGYQAA | 7927 | 21.95 |
| 21 | HCV H77 | 5 | A0201 | 2 | KQWR-GYQAAL | 7928 | 62.92 |
| 22 | HCV H77 | 6 | A68.1 | 10 | RTSSLSGRR | 7929 | 50 |
| 23 | HCV H77 | 6 | A68.1 | 2 | RPASRRARR | 7930 | 10 |
| 24 | HCV H77 | 7 | A0201 | 11 | KLLCHKHLL | 7931 | 276.64 |
| 25 | HCV H77 | 7 | A0201 | 12 | LLCHKHLLST | 7932 | 29.14 |
| 26 | HCV H77 | 7 | A0201 | 18 | LLSTRRRQGT | 7933 | 12.67 |
| 27 | HCV H77 | 7 | A24 | 11 | KLLCHKHLL | 7934 | 12 |
| 28 | HCV H77 | 7 | A68.1 | 20 | STRRRQGTCR | 7935 | 50 |
| 29 | HCV H77 | 7 | A68.1 | 7 | GTRHKLLCHK | 7936 | 45 |
| 30 | HCV H77 | 7 | B3501 | 3 | HPWSGTRHKL | 7937 | 20 |
| 31 | HCV H77 | 7 | B7 | 3 | HPWSGTRHKL | 7938 | 120 |
| 32 | HCV H77 | 8 | B3501 | 10 | SPQGLGPHW | 7939 | 10 |
| 33 | HCV H77 | 8 | B3501 | 10 | SPQGLGPHWY | 7940 | 40 |

TABLE 4n-continued

H77 (4-6)

| No | Strain | ORF | HLA | Start | Sequence | SEQ ID NO: | Score |
|---|---|---|---|---|---|---|---|
| 34 | HCV H77 | 9 | A68.1 | 3 | WSSFRPRGR | 7941 | 15 |
| 35 | HCV H77 | 9 | B3501 | 7 | RPRGRQSSI | 7942 | 48 |
| 36 | HCV H77 | 9 | B7 | 7 | RPRGRQSSI | 7943 | 80 |
| 37 | HCV H77 | 9 | B8 | 7 | RPRGRQSSI | 7944 | 40 |
| 38 | HCV H77 | 10 | A1 | 2 | ATESAPLTR | 7945 | 112.5 |
| 39 | HCV H77 | 10 | A68.1 | 57 | DTTQSRRTR | 7946 | 150 |
| 40 | HCV H77 | 10 | A68.1 | 2 | ATESAPLTR | 7947 | 50 |
| 41 | HCV H77 | 10 | A68.1 | 63 | RTRGRTQDR | 7948 | 50 |
| 42 | HCV H77 | 10 | A68.1 | 39 | EATSRRGRR | 7949 | 15 |
| 43 | HCV H77 | 10 | A68.1 | 6 | APLTRQEQR | 7950 | 10 |
| 44 | HCV H77 | 10 | A68.1 | 35 | GAGGEATSR | 7951 | 10 |
| 45 | HCV H77 | 10 | A68.1 | 17 | TTRPPPCPVR | 7952 | 75 |
| 46 | HCV H77 | 10 | A68.1 | 58 | TTQSRRTRGR | 7953 | 50 |
| 47 | HCV H77 | 10 | A68.1 | 6 | APLTRQEQRR | 7954 | 15 |
| 48 | HCV H77 | 10 | A68.1 | 41 | TSRRGRRPLR | 7955 | 15 |
| 49 | HCV H77 | 10 | A68.1 | 35 | GAGGEATSRR | 7956 | 10 |
| 50 | HCV H77 | 10 | B3501 | 19 | RPPPCPVRM | 7957 | 80 |
| 51 | HCV H77 | 10 | B3501 | 41 | TSRRGRRPL | 7958 | 15 |
| 52 | HCV H77 | 10 | B7 | 41 | TSRRGRRPL | 7959 | 60 |
| 53 | HCV H77 | 10 | B7 | 19 | RPPPCPVRM | 7960 | 20 |
| 54 | HCV H77 | 10 | B7 | 40 | ATSRRGRRPL | 7961 | 18 |
| 55 | HCV H77 | 11 | A68.1 | 8 | GSNQWGRAR | 7962 | 15 |
| 56 | HCV H77 | 11 | A68.1 | 6 | VCGSNQWGR | 7963 | 10 |
| 57 | HCV H77 | 11 | A68.1 | 50 | DVCGSN-QWGR | 7964 | 600 |
| 58 | HCV H77 | 11 | B3501 | 14 | RARCCCPPL | 7965 | 18 |
| 59 | HCV H77 | 11 | B7 | 14 | RARCCCPPL | 7966 | 120 |
| 60 | HCV H77 | 13 | A0201 | 2 | ALPGGGVLEA | 7967 | 11.43 |
| 61 | HCV H77 | 13 | A1 | 8 | VLEAARHSY | 7968 | 45 |
| 62 | HCV H77 | 13 | B7 | 1 | MALPGGGVL | 7969 | 12 |
| 63 | HCV H77 | 14 | A68.1 | 8 | RSRQNQNQR | 7970 | 15 |
| 64 | HCV H77 | 15 | A24 | 29 | SFLRHAATL | 7971 | 30 |
| 65 | HCV H77 | 15 | A24 | 29 | SFLRHAATLL | 7972 | 30 |
| 66 | HCV H77 | 15 | A68.1 | 1 | MAALPPLDR | 7973 | 10 |
| 67 | HCV H77 | 15 | A68.1 | 10 | SLARTLRAR | 7974 | 10 |
| 68 | HCV H77 | 15 | A68.1 | 9 | RSLARTLRAR | 7975 | 30 |
| 69 | HCV H77 | 15 | B7 | 30 | FLRHAATLL | 7976 | 40 |
| 70 | HCV H77 | 15 | B7 | 3 | ALPPLDRSL | 7977 | 12 |
| 71 | HCV H77 | 15 | B7 | 11 | LARTLRARCL | 7978 | 120 |
| 72 | HCV H77 | 15 | B7 | 2 | AALPPLDRSL | 7979 | 36 |
| 73 | HCV H77 | 15 | B8 | 11 | LARTLRARCL | 7980 | 320 |
| 74 | HCV H77 | 17 | A0201 | 33 | CLAVSHAAL | 7981 | 21.36 |
| 75 | HCV H77 | 17 | A0201 | 21 | MIMLPSQEL | 7982 | 18.48 |
| 76 | HCV H77 | 17 | A0201 | 22 | IMLPSQELT | 7983 | 16.59 |
| 77 | HCV H77 | 17 | A0201 | 23 | MLPSQELTGV | 7984 | 271.95 |
| 78 | HCV H77 | 17 | A0201 | 8 | VISIILAHSV | 7985 | 16.26 |
| 79 | HCV H77 | 17 | A0201 | 20 | NMIMLPSQEL | 7986 | 15.43 |
| 80 | HCV H77 | 17 | A3 | 3 | TLKKWVISI | 7987 | 10.8 |
| 81 | HCV H77 | 17 | A68.1 | 35 | AVSHAALAR | 7988 | 200 |
| 82 | HCV H77 | 17 | A68.1 | 34 | LAVSHAALAR | 7989 | 10 |
| 83 | HCV H77 | 17 | A68.1 | 40 | ALARGVVGSR | 7990 | 10 |
| 84 | HCV H77 | 17 | B3501 | 15 | HSVGANMIM | 7991 | 10 |
| 85 | HCV H77 | 17 | B4403 | 27 | QELTGVCLA | 7992 | 24 |
| 86 | HCV H77 | 17 | B4403 | 27 | QELTGVCLAV | 7993 | 12 |
| 87 | HCV H77 | 17 | B7 | 16 | SVGANMIML | 7994 | 20 |
| 88 | HCV H77 | 17 | B7 | 21 | MIMLPSQEL | 7995 | 18 |
| 89 | HCV H77 | 18 | A68.1 | 6 | SPAARQAAR | 7996 | 10 |
| 90 | HCV H77 | 18 | A68.1 | 1 | MVQSWSPAAR | 7997 | 200 |
| 91 | HCV H77 | 18 | A68.1 | 5 | WSPAARQAAR | 7998 | 15 |
| 92 | HCV H77 | 18 | B3501 | 8 | AAR-QAARALM | 7999 | 18 |
| 93 | HCV H77 | 18 | B7 | 8 | AARQAARAL | 8000 | 360 |
| 94 | HCV H77 | 18 | B7 | 8 | AAR-QAARALM | 8001 | 135 |
| 95 | HCV H77 | 18 | B8 | 8 | AARQAARAL | 8002 | 16 |
| 96 | HCV H77 | 20 | A0201 | 15 | YENPIGVFL | 8003 | 10.51 |
| 97 | HCV H77 | 20 | A0201 | 13 | VSYENPIGV | 8004 | 10.13 |
| 98 | HCV H77 | 20 | A1 | 6 | TVESKQRVSY | 8005 | 90 |
| 99 | HCV H77 | 20 | A24 | 14 | SYENPIGVF | 8006 | 150 |
| 100 | HCV H77 | 20 | A24 | 14 | SYENPIGVFL | 8007 | 420 |
| 101 | HCV H77 | 20 | A3 | 2 | SLSVTVESK | 8008 | 60 |
| 102 | HCV H77 | 20 | A68.1 | 4 | SVTVESKQR | 8009 | 200 |
| 103 | HCV H77 | 20 | A68.1 | 3 | LSVTVESKQR | 8010 | 30 |
| 104 | HCV H77 | 20 | A68.1 | 1 | MSLSVTVESK | 8011 | 18 |
| 105 | HCV H77 | 20 | B3501 | 17 | NPIGVFLDF | 8012 | 20 |

TABLE 4n-continued

H77 (4-6)

| No | Strain | ORF | HLA | Start | Sequence | SEQ ID NO: | Score |
|---|---|---|---|---|---|---|---|
| 106 | HCV H77 | 20 | B3501 | 31 | NSTRCPGEY | 8013 | 10 |
| 107 | HCV H77 | 20 | B3501 | 13 | VSYENPIGVF | 8014 | 10 |
| 108 | HCV H77 | 20 | B4403 | 7 | VESKQRVSY | 8015 | 120 |
| 109 | HCV H77 | 20 | B4403 | 17 | NPIGVFLDF | 8016 | 11.25 |
| 110 | HCV H77 | 22 | A0201 | 20 | LMWATAFLA | 8017 | 293.63 |
| 111 | HCV H77 | 22 | A0201 | 19 | ELMWATAFL | 8018 | 32.6 |
| 112 | HCV H77 | 22 | A0201 | 26 | FLAWQRTSFA | 8019 | 125.69 |
| 113 | HCV H77 | 22 | A0201 | 9 | TLSSRRSFHT | 8020 | 43.22 |
| 114 | HCV H77 | 22 | A0201 | 1 | MMVVSIGVTL | 8021 | 26.23 |
| 115 | HCV H77 | 22 | A1 | 17 | HTELMWATAF | 8022 | 22.5 |
| 116 | HCV H77 | 22 | A24 | 25 | AFLAWQRTSF | 8023 | 15 |
| 117 | HCV H77 | 22 | A68.1 | 23 | ATAFLAWQR | 8024 | 100 |
| 118 | HCV H77 | 22 | A68.1 | 5 | SIGVTLSSR | 8025 | 10 |
| 119 | HCV H77 | 22 | A68.1 | 4 | VSIGVTLSSR | 8026 | 30 |
| 120 | HCV H77 | 22 | A68.1 | 5 | SIGVTLSSRR | 8027 | 10 |
| 121 | HCV H77 | 22 | B3501 | 11 | SSRRSFHTEL | 8028 | 15 |
| 122 | HCV H77 | 22 | B4403 | 18 | TELMWATAF | 8029 | 180 |
| 123 | HCV H77 | 22 | B4403 | 18 | TELMWATAFL | 8030 | 18 |
| 124 | HCV H77 | 22 | B7 | 2 | MVVSIGVTL | 8031 | 20 |
| 125 | HCV H77 | 22 | B7 | 19 | ELMWATAFL | 8032 | 12 |
| 126 | HCV H77 | 22 | B7 | 11 | SSRRSFHTEL | 8033 | 40 |
| 127 | HCV H77 | 24 | A0201 | 17 | KAVDRVDSV | 8034 | 15.62 |
| 128 | HCV H77 | 24 | A0201 | 11 | LVASSAKAV | 8035 | 10.35 |
| 129 | HCV H77 | 24 | A0201 | 10 | LLVASSAKAV | 8036 | 118.24 |
| 130 | HCV H77 | 24 | A0201 | 9 | KLLVASSAKA | 8037 | 64.34 |
| 131 | HCV H77 | 24 | A1 | 1 | MPEVEELPK | 8038 | 22.5 |
| 132 | HCV H77 | 24 | A3 | 9 | KLLVASSAK | 8039 | 90 |
| 133 | HCV H77 | 24 | A68.1 | 18 | AVDRVDSVR | 8040 | 300 |
| 134 | HCV H77 | 24 | A68.1 | 13 | ASSAKAVDR | 8041 | 15 |
| 135 | HCV H77 | 24 | A68.1 | 3 | EVEELPKLL | 8042 | 12 |
| 136 | HCV H77 | 24 | A68.1 | 21 | RVDSVRTTVR | 8043 | 200 |
| 137 | HCV H77 | 24 | A68.1 | 24 | SVRTTVRFFR | 8044 | 200 |
| 138 | HCV H77 | 24 | A68.1 | 17 | KAVDRVDSVR | 8045 | 15 |
| 139 | HCV H77 | 24 | A68.1 | 3 | EVEELPKLLV | 8046 | 12 |
| 140 | HCV H77 | 24 | B4403 | 5 | EELPKLLVA | 8047 | 36 |
| 141 | HCV H77 | 24 | B4403 | 5 | EELPKLLVAS | 8048 | 24 |
| 142 | HCV H77 | 24 | B4403 | 23 | DSVRTTVRFF | 8049 | 18 |
| 143 | HCV H77 | 24 | B7 | 1 | MPEVEELPKL | 8050 | 24 |
| 144 | HCV H77 | 25 | A0201 | 52 | NLLPAASAV | 8051 | 257.34 |
| 145 | HCV H77 | 25 | A0201 | 60 | VIWEGSVSM | 8052 | 39.52 |
| 146 | HCV H77 | 25 | A0201 | 125 | GIWHGHLRL | 8053 | 24.38 |
| 147 | HCV H77 | 25 | A0201 | 132 | RLSVVIPDT | 8054 | 17.14 |
| 148 | HCV H77 | 25 | A0201 | 7 | CLHRRLASM | 8055 | 11.43 |
| 149 | HCV H77 | 25 | A0201 | 29 | ALRDGADSWL | 8056 | 36.61 |
| 150 | HCV H77 | 25 | A0201 | 52 | NLLPAASAVI | 8057 | 15.83 |
| 151 | HCV H77 | 25 | A1 | 82 | NCDPTGYSW | 8058 | 10 |
| 152 | HCV H77 | 25 | A24 | 102 | KGLQGGANL | 8059 | 12 |
| 153 | HCV H77 | 25 | A3 | 23 | WLAVQVALR | 8060 | 12 |
| 154 | HCV H77 | 25 | A3 | 103 | GLQGGANLCR | 8061 | 36 |
| 155 | HCV H77 | 25 | A3 | 1 | MLPPISCLHR | 8062 | 12 |
| 156 | HCV H77 | 25 | A68.1 | 23 | WLAVQVALR | 8063 | 10 |
| 157 | HCV H77 | 25 | A68.1 | 92 | PTLNDTSSR | 8064 | 10 |
| 158 | HCV H77 | 25 | A68.1 | 104 | LQGGANLCR | 8065 | 10 |
| 159 | HCV H77 | 25 | A68.1 | 1 | MLPPISCLHR | 8066 | 11.25 |
| 160 | HCV H77 | 25 | A68.1 | 104 | LQGGANLCRR | 8067 | 10 |
| 161 | HCV H77 | 25 | B3501 | 54 | LPAASAVIW | 8068 | 10 |
| 162 | HCV H77 | 25 | B4403 | 20 | GESWLAVQVA | 8069 | 18 |
| 163 | HCV H77 | 25 | B7 | 42 | LAIEGGDPL | 8070 | 12 |
| 164 | HCV H77 | 25 | B7 | 29 | ALRDGADSWL | 8071 | 120 |
| 165 | HCV H77 | 25 | B7 | 59 | AVIWEGSVSM | 8072 | 15 |
| 166 | HCV H77 | 25 | B8 | 29 | ALRDGADSWL | 8073 | 12 |
| 167 | HCV H77 | 26 | A0201 | 12 | VLGPTILIV | 8074 | 111.5 |
| 168 | HCV H77 | 26 | A0201 | 62 | GMSLAFSQV | 8075 | 95.44 |
| 169 | HCV H77 | 26 | A0201 | 22 | FLTCPVISA | 8076 | 52.56 |
| 170 | HCV H77 | 26 | A0201 | 9 | FLQVLGPTI | 8077 | 47.99 |
| 171 | HCV H77 | 26 | A0201 | 16 | TILIVPFLT | 8078 | 21.99 |
| 172 | HCV H77 | 26 | A0201 | 17 | ILIVPFLTC | 8079 | 16.05 |
| 173 | HCV H77 | 26 | A0201 | 19 | IVPFLTCPV | 8080 | 10.35 |
| 174 | HCV H77 | 26 | A0201 | 84 | SLSQEPEHGV | 8081 | 69.55 |
| 175 | HCV H77 | 26 | A0201 | 9 | FLQVLGPTIL | 8082 | 40.29 |
| 176 | HCV H77 | 26 | A0201 | 27 | VISAPQWRV | 8083 | 27.64 |
| 177 | HCV H77 | 26 | A0201 | 38 | IMPSPRQTPL | 8084 | 26.23 |
| 178 | HCV H77 | 26 | A0201 | 62 | GMSLAFSQVL | 8085 | 24.04 |
| 179 | HCV H77 | 26 | A0201 | 11 | QVLGPTILIV | 8086 | 21.23 |
| 180 | HCV H77 | 26 | A0201 | 18 | LIVPFLTCPV | 8087 | 16.26 |

TABLE 4n-continued

H77 (4-6)

| No | Strain | ORF | HLA | Start | Sequence | SEQ ID NO: | Score |
|---|---|---|---|---|---|---|---|
| 181 | HCV H77 | 26 | A0201 | 3 | NVPLHMFLQV | 8088 | 11.56 |
| 182 | HCV H77 | 26 | A24 | 66 | AFSQVLKSL | 8089 | 28 |
| 183 | HCV H77 | 26 | A3 | 64 | SLAFSQVLK | 8090 | 20 |
| 184 | HCV H77 | 26 | A3 | 46 | PLYPRWQDTK | 8091 | 45 |
| 185 | HCV H77 | 26 | A68.1 | 35 | RVCIMPSPR | 8092 | 200 |
| 186 | HCV H77 | 26 | A68.1 | 92 | GVVHSELIH | 8093 | 12 |
| 187 | HCV H77 | 26 | A68.1 | 26 | PVISAPQWQR | 8094 | 40 |
| 188 | HCV H77 | 26 | A68.1 | 63 | MSLAFSQVLK | 8095 | 18 |
| 189 | HCV H77 | 26 | B3501 | 14 | GPTILIVPF | 8096 | 20 |
| 190 | HCV H77 | 26 | B3501 | 39 | MPSPRQTPL | 8097 | 20 |
| 191 | HCV H77 | 26 | B3501 | 57 | IPGSCGMSL | 8098 | 20 |
| 192 | HCV H77 | 26 | B3501 | 25 | CPVISAPQW | 8099 | 10 |
| 193 | HCV H77 | 26 | B3501 | 30 | APQWQRVCIM | 8100 | 40 |
| 194 | HCV H77 | 26 | B3501 | 39 | MPSPRQTPLY | 8101 | 40 |
| 195 | HCV H77 | 26 | B3501 | 48 | YPRWQDTKGI | 8102 | 36 |
| 196 | HCV H77 | 26 | B3501 | 4 | VPLHMFLQVL | 8103 | 20 |
| 197 | HCV H77 | 26 | B3501 | 14 | GPTILIVPFL | 8104 | 20 |
| 198 | HCV H77 | 26 | B3501 | 74 | LSTSHIQSQM | 8105 | 10 |
| 199 | HCV H77 | 26 | B4403 | 87 | QEPEHGVVHS | 8106 | 12 |
| 200 | HCV H77 | 26 | B7 | 39 | MPSPRQTPL | 8107 | 80 |
| 201 | HCV H77 | 26 | B7 | 57 | IPGSCGMSL | 8108 | 80 |
| 202 | HCV H77 | 26 | B7 | 30 | APQWQRVCI | 8109 | 36 |
| 203 | HCV H77 | 26 | B7 | 4 | VPLHMFLQVL | 8110 | 80 |
| 204 | HCV H77 | 26 | B7 | 14 | GPTILIVPFL | 8111 | 80 |
| 205 | HCV H77 | 26 | B7 | 48 | YPRWQDTKGI | 8112 | 80 |
| 206 | HCV H77 | 26 | B7 | 30 | APQWQRVCIM | 8113 | 60 |
| 207 | HCV H77 | 26 | B7 | 65 | LAFSQVLKSL | 8114 | 12 |
| 208 | HCV H77 | 26 | B8 | 39 | MPSPRQTPL | 8115 | 16 |
| 209 | HCV H77 | 27 | B7 | 2 | AVTRAAASL | 8116 | 60 |
| 210 | HCV H77 | 27 | B7 | 1 | MAVTRAAASL | 8117 | 12 |
| 211 | HCV H77 | 28 | A0201 | 76 | MLKRRVWPV | 8118 | 71.39 |
| 212 | HCV H77 | 28 | A0201 | 80 | RVWPVVSGL | 8119 | 35.68 |
| 213 | HCV H77 | 28 | A0201 | 95 | AINEAMAGL | 8120 | 27.7 |
| 214 | HCV H77 | 28 | A0201 | 132 | CQLVWTAGV | 8121 | 26.09 |
| 215 | HCV H77 | 28 | A0201 | 127 | KTSSFCQLV | 8122 | 12.85 |
| 216 | HCV H77 | 28 | A0201 | 75 | NMLKRRVWPV | 8123 | 3206.06 |
| 217 | HCV H77 | 28 | A0201 | 87 | GLVTAAVKAI | 8124 | 24 |
| 218 | HCV H77 | 28 | A0201 | 19 | ILNATRAPAT | 8125 | 12.67 |
| 219 | HCV H77 | 28 | A0201 | 84 | VVSGLVTAAV | 8126 | 10.35 |
| 220 | HCV H77 | 28 | A1 | 70 | ATHPPNMLK | 8127 | 25 |
| 221 | HCV H77 | 28 | A1 | 70 | ATHPPNMLKR | 8128 | 12.5 |
| 222 | HCV H77 | 28 | A24 | 112 | KYCIPLMKF | 8129 | 220 |
| 223 | HCV H77 | 28 | A24 | 80 | RVWPVVSGL | 8130 | 13.44 |
| 224 | HCV H77 | 28 | A24 | 123 | CFAQKTSSF | 8131 | 10 |
| 225 | HCV H77 | 28 | A24 | 94 | KAINEAMAGL | 8132 | 12 |
| 226 | HCV H77 | 28 | A3 | 163 | SIIPCSMYGK | 8133 | 20.25 |
| 227 | HCV H77 | 28 | A68.1 | 27 | ATPAPYPAR | 8134 | 50 |
| 228 | HCV H77 | 28 | A68.1 | 70 | ATHPPNMLK | 8135 | 45 |
| 229 | HCV H77 | 28 | A68.1 | 70 | ATHPPNMLKR | 8136 | 75 |
| 230 | HCV H77 | 28 | A68.1 | 142 | TSAWRDAVCR | 8137 | 30 |
| 231 | HCV H77 | 28 | A68.1 | 85 | VSGLVTAAVK | 8138 | 18 |
| 232 | HCV H77 | 28 | A68.1 | 44 | PTLPMAAPAR | 8139 | 15 |
| 233 | HCV H77 | 28 | A68.1 | 15 | SPLMILNATR | 8140 | 10 |
| 234 | HCV H77 | 28 | A68.1 | 100 | MAGLPGSVDR | 8141 | 10 |
| 235 | HCV H77 | 28 | A68.1 | 137 | TAGVITSAWR | 8142 | 10 |
| 236 | HCV H77 | 28 | B3501 | 28 | TPAPYPARM | 8143 | 40 |
| 237 | HCV H77 | 28 | B3501 | 109 | RPAKYCIPL | 8144 | 40 |
| 238 | HCV H77 | 28 | B3501 | 105 | GSVDRPAKY | 8145 | 20 |
| 239 | HCV H77 | 28 | B3501 | 24 | RAPATPAPY | 8146 | 12 |
| 240 | HCV H77 | 28 | B3501 | 152 | RPRAFCLNC | 8147 | 12 |
| 241 | HCV H77 | 28 | B3501 | 9 | SSVEGTSPL | 8148 | 10 |
| 242 | HCV H77 | 28 | B3501 | 162 | ASIIPCSMY | 8149 | 10 |
| 243 | HCV H77 | 28 | B3501 | 109 | RPAKYCIPLM | 8150 | 80 |
| 244 | HCV H77 | 28 | B3501 | 115 | IPLMKFHMCF | 8151 | 20 |
| 245 | HCV H77 | 28 | B3501 | 9 | SSVEGTSPLM | 8152 | 20 |
| 246 | HCV H77 | 28 | B3501 | 32 | YPARMSTRTF | 8153 | 20 |
| 247 | HCV H77 | 28 | B3501 | 152 | RPRAFCLNCS | 8154 | 12 |
| 248 | HCV H77 | 28 | B3501 | 8 | RSSVEGTSPL | 8155 | 10 |
| 249 | HCV H77 | 28 | B3501 | 160 | CSASIIPCSM | 8156 | 10 |
| 250 | HCV H77 | 28 | B3501 | 162 | ASIIPCSMY | 8157 | 45 |
| 251 | HCV H77 | 28 | B4403 | 97 | NEAMAGLPGS | 8158 | 12 |
| 252 | HCV H77 | 28 | B7 | 109 | RPAKYCIPL | 8159 | 80 |
| 253 | HCV H77 | 28 | B7 | 69 | AATHPPNML | 8160 | 54 |
| 254 | HCV H77 | 28 | B7 | 28 | TPAPYPARM | 8161 | 20 |
| 255 | HCV H77 | 28 | B7 | 80 | RVWPVVSGL | 8162 | 20 |

TABLE 4n-continued

H77 (4-6)

| No | Strain | ORF | HLA | Start | Sequence | SEQ ID NO: | Score |
|---|---|---|---|---|---|---|---|
| 256 | HCV H77 | 28 | B7 | 152 | RPRAFCLNC | 8163 | 20 |
| 257 | HCV H77 | 28 | B7 | 92 | AVKAINEAM | 8164 | 15 |
| 258 | HCV H77 | 28 | B7 | 95 | AINEAMAGL | 8165 | 12 |
| 259 | HCV H77 | 28 | B7 | 37 | STRTFPSPTL | 8166 | 60 |
| 260 | HCV H77 | 28 | B7 | 149 | VCRRPRAFCL | 8167 | 40 |
| 261 | HCV H77 | 28 | B7 | 109 | RPAKYCIPLM | 8168 | 20 |
| 262 | HCV H77 | 28 | B7 | 68 | WAATHPPNML | 8169 | 18 |
| 263 | HCV H77 | 28 | B7 | 94 | KAINEAMAGL | 8170 | 12 |
| 264 | HCV H77 | 28 | B7 | 125 | AQKTSSFCQL | 8171 | 12 |
| 265 | HCV H77 | 28 | B8 | 76 | MLKRRVWPV | 8172 | 24 |
| 266 | HCV H77 | 28 | B8 | 149 | VCRRPRAFCL | 8173 | 320 |
| 267 | HCV H77 | 29 | A0201 | 39 | YLVIGCVRV | 8174 | 319.94 |
| 268 | HCV H77 | 29 | A0201 | 37 | MMYLVIGCV | 8175 | 81.71 |
| 269 | HCV H77 | 29 | A0201 | 36 | VMMYLVIGC | 8176 | 51.91 |
| 270 | HCV H77 | 29 | A0201 | 36 | VMMYLVIGCV | 8177 | 94.47 |
| 271 | HCV H77 | 29 | A1 | 31 | SADMHVMMY | 8178 | 125 |
| 272 | HCV H77 | 29 | A1 | 2 | TTQPVDRQY | 8179 | 12.5 |
| 273 | HCV H77 | 29 | A24 | 16 | RTPPTSTQVL | 8180 | 17.28 |
| 274 | HCV H77 | 29 | A3 | 37 | MMYLVIGCVR | 8181 | 30 |
| 275 | HCV H77 | 29 | A68.1 | 5 | PVDRQYAAR | 8182 | 20 |
| 276 | HCV H77 | 29 | A68.1 | 22 | TQVLVTTSR | 8183 | 10 |
| 277 | HCV H77 | 29 | A68.1 | 21 | STQVLVTTSR | 8184 | 50 |
| 278 | HCV H77 | 29 | A68.1 | 4 | QPVDRQYAAR | 8185 | 10 |
| 279 | HCV H77 | 29 | B3501 | 30 | RSADMHVMM | 8186 | 40 |
| 280 | HCV H77 | 29 | B3501 | 17 | TPPTSTQVL | 8187 | 20 |
| 281 | HCV H77 | 29 | B3501 | 28 | TSRSADM-HVM | 8188 | 45 |
| 282 | HCV H77 | 29 | B3501 | 30 | RSADMH-VMMY | 8189 | 40 |
| 283 | HCV H77 | 29 | B4403 | 31 | SADMHVMMY | 8190 | 18 |
| 284 | HCV H77 | 29 | B4403 | 30 | RSADMH-VMMY | 8191 | 18 |
| 285 | HCV H77 | 29 | B7 | 17 | TPPTSTQVL | 8192 | 80 |
| 286 | HCV H77 | 29 | B7 | 14 | AARTPPTST | 8193 | 13.5 |
| 287 | HCV H77 | 29 | B7 | 28 | TSRSADM-HVM | 8194 | 10 |
| 288 | HCV H77 | 29 | B8 | 11 | AARAARTPPT | 8195 | 16 |
| 289 | HCV H77 | 30 | A0201 | 5 | SLTVVSAGV | 8196 | 69.55 |
| 290 | HCV H77 | 31 | B7 | 3 | EGRSPGATNL | 8197 | 40 |
| 291 | HCV H77 | 32 | A68.1 | 4 | FPLPVLPRR | 8198 | 15 |
| 292 | HCV H77 | 32 | B3501 | 1 | MPGFPLPVL | 8199 | 20 |
| 293 | HCV H77 | 32 | B7 | 1 | MPGFPLPVL | 8200 | 120 |
| 294 | HCV H77 | 33 | A0201 | 3 | KVGSRLKSTV | 8201 | 21.3 |
| 295 | HCV H77 | 33 | A68.1 | 1 | MVKVGSRLK | 8202 | 120 |
| 296 | HCV H77 | 34 | A68.1 | 13 | LVGMTDTSR | 8203 | 600 |
| 297 | HCV H77 | 35 | A24 | 6 | SFAASSSHF | 8204 | 10 |
| 298 | HCV H77 | 35 | A24 | 15 | FFEWQKMRCL | 8205 | 30 |
| 299 | HCV H77 | 35 | A24 | 6 | SFAASSSHFF | 8206 | 10 |
| 300 | HCV H77 | 35 | A68.1 | 22 | RCLPPLITSR | 8207 | 15 |
| 301 | HCV H77 | 35 | A68.1 | 11 | SSHFFFEWQK | 8208 | 13.5 |
| 302 | HCV H77 | 36 | A0201 | 6 | TVTEPGGVAV | 8209 | 24.95 |
| 303 | HCV H77 | 36 | A1 | 7 | VTEPGGVAV | 8210 | 45 |
| 304 | HCV H77 | 36 | A1 | 7 | VTEPGGVAVA | 8211 | 45 |
| 305 | HCV H77 | 36 | A68.1 | 22 | APAVSAWSR | 8212 | 10 |
| 306 | HCV H77 | 36 | B3501 | 34 | MPKMDVASV | 8213 | 18 |
| 307 | HCV H77 | 36 | B3501 | 28 | WSRTVP-MPKM | 8214 | 30 |
| 308 | HCV H77 | 36 | B3501 | 25 | VSAWSRTVPM | 8215 | 10 |
| 309 | HCV H77 | 36 | B4403 | 8 | TEPGGVAVA | 8216 | 18 |
| 310 | HCV H77 | 36 | B4403 | 8 | TEPGGVAVAS | 8217 | 13.5 |
| 311 | HCV H77 | 36 | B7 | 13 | VAVASTTSL | 8218 | 12 |
| 312 | HCV H77 | 36 | B7 | 12 | GVAVASTTSL | 8219 | 20 |
| 313 | HCV H77 | 36 | B7 | 28 | WSRTVP-MPKM | 8220 | 15 |
| 314 | HCV H77 | 37 | A0201 | 14 | ILGSTPWAL | 8221 | 272.37 |
| 315 | HCV H77 | 37 | A0201 | 13 | LILGSTPWA | 8222 | 23.63 |
| 316 | HCV H77 | 37 | A0201 | 2 | GLPVVIVLT | 8223 | 17.14 |
| 317 | HCV H77 | 37 | A0201 | 7 | IVLTPVLIL | 8224 | 11.09 |
| 318 | HCV H77 | 37 | A0201 | 13 | LILGSTPWAL | 8225 | 138.57 |
| 319 | HCV H77 | 37 | A0201 | 12 | VLILGSTPWA | 8226 | 46.45 |
| 320 | HCV H77 | 37 | A24 | 1 | MGLPVVIVL | 8227 | 10.08 |
| 321 | HCV H77 | 37 | B3501 | 16 | GSTPWALDM | 8228 | 10 |
| 322 | HCV H77 | 37 | B7 | 7 | IVLTPVLIL | 8229 | 30 |
| 323 | HCV H77 | 37 | B7 | 5 | VVIVLTPVL | 8230 | 20 |
| 324 | HCV H77 | 38 | A0201 | 14 | ALATPRVHTA | 8231 | 11.43 |

TABLE 4n-continued

H77 (4-6)

| No | Strain | ORF | HLA | Start | Sequence | SEQ ID NO: | Score |
|---|---|---|---|---|---|---|---|
| 325 | HCV H77 | 38 | A68.1 | 19 | RVHTAALNR | 8232 | 200 |
| 326 | HCV H77 | 38 | A68.1 | 11 | KSTALATPR | 8233 | 15 |
| 327 | HCV H77 | 28 | A68.1 | 2 | VVPRFSTGIK | 8234 | 120 |
| 328 | HCV H77 | 38 | A68.1 | 36 | NSGPPEEPFK | 8235 | 40.5 |
| 329 | HCV H77 | 38 | A68.1 | 1 | MVVPRFSTGI | 8236 | 12 |
| 330 | HCV H77 | 38 | B3501 | 17 | TPRVHTAAL | 8237 | 60 |
| 331 | HCV H77 | 38 | B7 | 17 | TPRVHTAAL | 8238 | 800 |
| 332 | HCV H77 | 38 | B7 | 16 | ATPRVHTAAL | 8239 | 12 |
| 333 | HCV H77 | 38 | B8 | 17 | TPRVHTAAL | 8240 | 16 |
| 334 | HCV H77 | 39 | A24 | 3 | RGESRLPLL | 8241 | 12 |
| 335 | HCV H77 | 39 | A3 | 18 | GMTSACLVTR | 8242 | 18 |
| 336 | HCV H77 | 39 | A68.1 | 19 | MTSACLVTR | 8243 | 50 |
| 337 | HCV H77 | 39 | A68.1 | 8 | LPLLSPRRR | 8244 | 10 |
| 338 | HCV H77 | 39 | A68.1 | 5 | ESRLPLLSPR | 8245 | 45 |
| 339 | HCV H77 | 39 | B3501 | 11 | LSPRRRTGM | 8246 | 10 |
| 340 | HCV H77 | 39 | B7 | 12 | SPRRRTGMT | 8247 | 20 |
| 341 | HCV H77 | 39 | B7 | 1 | MGRGESRLPL | 8248 | 60 |
| 342 | HCV H77 | 39 | B8 | 12 | SPRRRTGMT | 8249 | 16 |
| 343 | HCV H77 | 40 | A0201 | 4 | PLGDAMVLV | 8250 | 14.43 |
| 344 | HCV H77 | 40 | B3501 | 3 | GPLGDAMVL | 8251 | 30 |
| 345 | HCV H77 | 40 | B7 | 3 | GPLGDAMVL | 8252 | 80 |
| 346 | HCV H77 | 41 | A0201 | 77 | LMMSPHAAV | 8253 | 315.96 |
| 347 | HCV H77 | 41 | A0201 | 22 | FLSRPVRLV | 8254 | 147.17 |
| 348 | HCV H77 | 41 | A0201 | 15 | WTSPSTWFL | 8255 | 56.3 |
| 349 | HCV H77 | 41 | A0201 | 6 | KVWVAVDTI | 8256 | 29.89 |
| 350 | HCV H77 | 41 | A0201 | 8 | WVAVDTIWT | 8257 | 16.5 |
| 351 | HCV H77 | 41 | A0201 | 31 | IIHPRRPLV | 8258 | 16.26 |
| 352 | HCV H77 | 41 | A0201 | 45 | VMGASNLHPL | 8259 | 60.33 |
| 353 | HCV H77 | 41 | A0201 | 22 | FLSRPVRLVI | 8260 | 19.68 |
| 354 | HCV H77 | 41 | A0201 | 30 | VIIHPRRPLV | 8261 | 16.26 |
| 355 | HCV H77 | 41 | A24 | 21 | WFLSRPVRL | 8262 | 30 |
| 356 | HCV H77 | 41 | A24 | 42 | AYAVMGASNL | 8263 | 200 |
| 357 | HCV H77 | 41 | A68.1 | 89 | HVMSLVSIR | 8264 | 400 |
| 358 | HCV H77 | 41 | A68.1 | 103 | STATARSRR | 8265 | 100 |
| 359 | HCV H77 | 41 | A68.1 | 100 | TTGSTATAR | 8266 | 100 |
| 360 | HCV H77 | 41 | A68.1 | 91 | MSLVSIREK | 8267 | 18 |
| 361 | HCV H77 | 41 | A68.1 | 102 | GSTATARSR | 8268 | 15 |
| 362 | HCV H77 | 41 | A68.1 | 28 | RLVIIHPRR | 8269 | 10 |
| 363 | HCV H77 | 41 | A68.1 | 111 | RPLCAQSRR | 8270 | 10 |
| 364 | HCV H77 | 41 | A68.1 | 19 | STWFLSRPVR | 8271 | 50 |
| 365 | HCV H77 | 41 | A68.1 | 99 | KTTGSTATAR | 8272 | 50 |
| 366 | HCV H77 | 41 | A68.1 | 26 | PVRLVIIHPR | 8273 | 20 |
| 367 | HCV H77 | 41 | A68.1 | 16 | TSPSTWFLSR | 8274 | 15 |
| 368 | HCV H77 | 41 | A68.1 | 102 | GSTATARSRR | 8275 | 15 |
| 369 | HCV H77 | 41 | A68.1 | 113 | LCAQSRRGVR | 8276 | 10 |
| 370 | HCV H77 | 41 | B3501 | 33 | HPRRPLVCW | 8277 | 30 |
| 371 | HCV H77 | 41 | B3501 | 61 | GPSSISWPL | 8278 | 20 |
| 372 | HCV H77 | 41 | B3501 | 116 | QSRRGVRWL | 8279 | 15 |
| 373 | HCV H77 | 41 | B3501 | 116 | QSRRGVRWLY | 8280 | 30 |
| 374 | HCV H77 | 41 | B4403 | 71 | AETGKPLMM | 8281 | 18 |
| 375 | HCV H77 | 41 | B4403 | 71 | AETGKPLMMS | 8282 | 18 |
| 376 | HCV H77 | 41 | B7 | 61 | GPSSISWPL | 8283 | 80 |
| 377 | HCV H77 | 41 | B7 | 116 | QSRRGVRWL | 8284 | 40 |
| 378 | HCV H77 | 41 | B7 | 105 | ATARSRRPL | 8285 | 18 |
| 379 | HCV H77 | 41 | B7 | 43 | YAVMGASNL | 8286 | 12 |
| 380 | HCV H77 | 41 | B7 | 84 | AVSAPHVMSL | 8287 | 60 |
| 381 | HCV H77 | 41 | B7 | 29 | LVIIHPRRPL | 8288 | 45 |
| 382 | HCV H77 | 41 | B7 | 87 | APHVMSLVSI | 8289 | 24 |
| 383 | HCV H77 | 41 | B7 | 33 | HPRRPLVCWA | 8290 | 20 |
| 384 | HCV H77 | 41 | B7 | 104 | TATARSRRPL | 8291 | 18 |
| 385 | HCV H77 | 41 | B7 | 60 | AGPSSISWPL | 8292 | 12 |
| 386 | HCV H77 | 41 | B7 | 115 | AQSRRGVRWL | 8293 | 12 |
| 387 | HCV H77 | 41 | B8 | 106 | TARSRRPLC | 8294 | 16 |
| 388 | HCV H77 | 41 | B8 | 23 | LSRPVRLVII | 8295 | 20 |
| 389 | HCV H77 | 41 | B8 | 106 | TARSRRPLCA | 8296 | 16 |
| 390 | HCV H77 | 42 | A0201 | 5 | SLVMSNTRV | 8297 | 69.55 |
| 391 | HCV H77 | 42 | A0201 | 21 | KMTASRPPRT | 8298 | 18.84 |
| 392 | HCV H77 | 42 | A3 | 21 | KMTASRPPR | 8299 | 12 |
| 393 | HCV H77 | 42 | A68.1 | 4 | SSLVMSNTR | 8300 | 30 |
| 394 | HCV H77 | 42 | A68.1 | 24 | ASRPPRTLR | 8301 | 22.5 |
| 395 | HCV H77 | 42 | A68.1 | 38 | CSCASTLVR | 8302 | 15 |
| 396 | HCV H77 | 42 | A68.1 | 12 | RVGCTTHMSK | 8303 | 240 |
| 397 | HCV H77 | 42 | A68.1 | 3 | RSSLVMSNTR | 8304 | 15 |
| 398 | HCV H77 | 42 | B4403 | 40 | CASTLVRKY | 8305 | 13.5 |
| 399 | HCV H77 | 42 | B4403 | 39 | SCASTLVRKY | 8306 | 54 |

TABLE 4n-continued

H77 (4-6)

| No | Strain | ORF | HLA | Start | Sequence | SEQ ID NO: | Score |
|---|---|---|---|---|---|---|---|
| 400 | HCV H77 | 42 | B7 | 23 | TASRPPRTL | 8307 | 18 |
| 401 | HCV H77 | 42 | B7 | 10 | NTRVGCTTHM | 8308 | 10 |
| 402 | HCV H77 | 43 | A0201 | 95 | VQLQAASSL | 8309 | 13.62 |
| 403 | HCV H77 | 43 | A0201 | 102 | SLCSTPPTYI | 8310 | 57.38 |
| 404 | HCV H77 | 43 | A0201 | 33 | MLDPTPYKYC | 8311 | 27.87 |
| 405 | HCV H77 | 43 | A1 | 33 | MLDPTPYKY | 8312 | 500 |
| 406 | HCV H77 | 43 | A24 | 40 | KYCTSTMFW | 8313 | 10 |
| 407 | HCV H77 | 43 | A24 | 88 | RSQRSPRVQL | 8314 | 12 |
| 408 | HCV H77 | 43 | A24 | 94 | RVQLQAASSL | 8315 | 12 |
| 409 | HCV H77 | 43 | A24 | 38 | PYKYCTSTMF | 8316 | 10 |
| 410 | HCV H77 | 43 | A24 | 40 | KYCTSTM-FWW | 8317 | 10 |
| 411 | HCV H77 | 43 | A3 | 45 | TMFWWR-WMR | 8318 | 180 |
| 412 | HCV H77 | 43 | A3 | 32 | AMLDPTPYK | 8319 | 45 |
| 413 | HCV H77 | 43 | A3 | 33 | MLDPTPYKY | 8320 | 18 |
| 414 | HCV H77 | 43 | A3 | 32 | AMLDPTPYKY | 8321 | 18 |
| 415 | HCV H77 | 43 | A68.1 | 42 | CTSTMFWWR | 8322 | 50 |
| 416 | HCV H77 | 43 | A68.1 | 10 | QTRASASRR | 8323 | 50 |
| 417 | HCV H77 | 43 | A68.1 | 83 | LSLSSRSQR | 8324 | 30 |
| 418 | HCV H77 | 43 | A68.1 | 13 | ASASRRNRR | 8325 | 30 |
| 419 | HCV H77 | 43 | A68.1 | 9 | EQTRASASR | 8326 | 15 |
| 420 | HCV H77 | 43 | A68.1 | 80 | SSDLSLSSR | 8327 | 15 |
| 421 | HCV H77 | 43 | A68.1 | 86 | SSRSQRSPR | 8328 | 15 |
| 422 | HCV H77 | 43 | A68.1 | 45 | TMFWWR-WMR | 8329 | 10 |
| 423 | HCV H77 | 43 | A68.1 | 44 | STMFWWR-WMR | 8330 | 100 |
| 424 | HCV H77 | 43 | A68.1 | 31 | DAMLDPTPYK | 8331 | 18 |
| 425 | HCV H77 | 43 | A68.1 | 3 | NIIHKQEQTR | 8332 | 15 |
| 426 | HCV H77 | 43 | A68.1 | 9 | EQTRASASRR | 8333 | 15 |
| 427 | HCV H77 | 43 | A68.1 | 79 | LSSDLSLSSR | 8334 | 15 |
| 428 | HCV H77 | 43 | A68.1 | 82 | DLSLSSRSQR | 8335 | 15 |
| 429 | HCV H77 | 43 | A68.1 | 85 | LSSRSQRSPR | 8336 | 15 |
| 430 | HCV H77 | 43 | A68.1 | 54 | PVDKAGRVVK | 8337 | 12 |
| 431 | HCV H77 | 43 | B3501 | 106 | TPPTYILTL | 8338 | 20 |
| 432 | HCV H77 | 43 | B3501 | 53 | RPVDKAGRV | 8339 | 16 |
| 433 | HCV H77 | 43 | B3501 | 37 | TPYKYCTSTM | 8340 | 40 |
| 434 | HCV H77 | 43 | B3501 | 15 | ASRRNRRTTY | 8341 | 30 |
| 435 | HCV H77 | 43 | B3501 | 53 | RPVDKAGRVV | 8342 | 16 |
| 436 | HCV H77 | 43 | B3501 | 24 | YSHLMAQDAM | 8343 | 10 |
| 437 | HCV H77 | 43 | B3501 | 43 | TSTMFW-WRWM | 8344 | 10 |
| 438 | HCV H77 | 43 | B3501 | 88 | RSQRSPRVQL | 8345 | 10 |
| 439 | HCV H77 | 43 | B3501 | 101 | SSLCSTPPTY | 8346 | 10 |
| 440 | HCV H77 | 43 | B4403 | 31 | DAMLDPTPY | 8347 | 27 |
| 441 | HCV H77 | 43 | B4403 | 30 | QDAMLDPTPY | 8348 | 45 |
| 442 | HCV H77 | 43 | B4403 | 101 | SSLCSTPPTY | 8349 | 12 |
| 443 | HCV H77 | 43 | B7 | 89 | SQRSPRVQL | 8350 | 90 |
| 444 | HCV H77 | 43 | B7 | 106 | TPPTYILTL | 8351 | 80 |
| 445 | HCV H77 | 43 | B7 | 71 | CVVDSSNGL | 8352 | 20 |
| 446 | HCV H77 | 43 | B7 | 92 | SPRVQLQAA | 8353 | 20 |
| 447 | HCV H77 | 43 | B7 | 26 | HLMAQDAML | 8354 | 12 |
| 448 | HCV H77 | 43 | B7 | 18 | RNRRTTYSHL | 8355 | 40 |
| 449 | HCV H77 | 43 | B7 | 37 | TPYKYCTSTM | 8356 | 20 |
| 450 | HCV H77 | 43 | B7 | 94 | RVQLQAASSL | 8357 | 20 |
| 451 | HCV H77 | 43 | B8 | 86 | SSRSQRSPRV | 8358 | 12 |
| 452 | HCV H77 | 44 | A0201 | 67 | VLLRTKTSV | 8359 | 437.48 |
| 453 | HCV H77 | 44 | A0201 | 46 | TLVNPVEFI | 8360 | 64.67 |
| 454 | HCV H77 | 44 | A0201 | 31 | VLLPTPPMT | 8361 | 46.87 |
| 455 | HCV H77 | 44 | A0201 | 23 | KQSVGQSKV | 8362 | 24.68 |
| 456 | HCV H77 | 44 | A0201 | 53 | FIQVQPNQL | 8363 | 13.51 |
| 457 | HCV H77 | 44 | A0201 | 60 | QLPSGGLVLL | 8364 | 49.13 |
| 458 | HCV H77 | 44 | A0201 | 66 | LVLLRTKTSV | 8365 | 38.28 |
| 459 | HCV H77 | 44 | A0201 | 47 | LVNPVEFIQV | 8366 | 19.66 |
| 460 | HCV H77 | 44 | A24 | 52 | EFIQVQPNQL | 8367 | 36 |
| 461 | HCV H77 | 44 | A68.1 | 15 | YVASGCLRK | 8368 | 240 |
| 462 | HCV H77 | 44 | A68.1 | 5 | VIQGPEPHR | 8369 | 11.25 |
| 463 | HCV H77 | 44 | A68.1 | 4 | GVIQGPEPHR | 8370 | 900 |
| 464 | HCV H77 | 44 | B3501 | 61 | LPSGGLVLL | 8371 | 20 |
| 465 | HCV H77 | 44 | B4403 | 57 | QPNQLPSGGL | 8372 | 20 |
| 466 | HCV H77 | 44 | B7 | 61 | LPSGGLVLL | 8373 | 80 |
| 467 | HCV H77 | 44 | B7 | 25 | SVGQSKVLL | 8374 | 20 |
| 468 | HCV H77 | 44 | B7 | 43 | APHTLVNPV | 8375 | 12 |

TABLE 4n-continued

H77 (4-6)

| No | Strain | ORF | HLA | Start | Sequence | SEQ ID NO: | Score |
|---|---|---|---|---|---|---|---|
| 469 | HCV H77 | 44 | B7 | 57 | QPNQLPSGGL | 8376 | 120 |
| 470 | HCV H77 | 45 | A0201 | 11 | WMFCLAPGV | 8377 | 854.95 |
| 471 | HCV H77 | 45 | A0201 | 7 | VLISWMFCL | 8378 | 484.46 |
| 472 | HCV H77 | 45 | A0201 | 6 | LVLISWMFC | 8379 | 25.57 |
| 473 | HCV H77 | 45 | A0201 | 6 | LVLISWMFCL | 8380 | 156.84 |
| 474 | HCV H77 | 45 | A0201 | 3 | QLPLVLISWM | 8381 | 62.85 |
| 475 | HCV H77 | 45 | A0201 | 7 | VLISWMFCLA | 8382 | 16.05 |
| 476 | HCV H77 | 45 | A0201 | 26 | AVVRPAFPPV | 8383 | 11.56 |
| 477 | HCV H77 | 45 | A0201 | 54 | AQFPTMEKYA | 8384 | 10.25 |
| 478 | HCV H77 | 45 | A3 | 7 | VLISWMFCL | 8385 | 12.15 |
| 479 | HCV H77 | 45 | A68.1 | 13 | FCLAPGVRR | 8386 | 10 |
| 480 | HCV H77 | 45 | B3501 | 56 | FPTMEKYAM | 8387 | 60 |
| 481 | HCV H77 | 45 | B3501 | 4 | LPLVLISWM | 8388 | 40 |
| 482 | HCV H77 | 45 | B3501 | 24 | SPAVVRPAF | 8389 | 20 |
| 483 | HCV H77 | 45 | B3501 | 29 | RPAFPPVTW | 8390 | 20 |
| 484 | HCV H77 | 45 | B3501 | 4 | LPLVLISWMF | 8391 | 20 |
| 485 | HCV H77 | 45 | B7 | 4 | LPLVLISWM | 8392 | 20 |
| 486 | HCV H77 | 45 | B7 | 56 | FPTMEKYAM | 8393 | 20 |
| 487 | HCV H77 | 45 | B7 | 27 | VVRPAFPPV | 8394 | 10 |
| 488 | HCV H77 | 45 | B7 | 6 | LVLISWMFCL | 8395 | 20 |
| 489 | HCV H77 | 45 | B7 | 18 | GVRRPTSPAV | 8396 | 10 |
| 490 | HCV H77 | 46 | A68.1 | 1 | MSMMACGIR | 8397 | 30 |
| 491 | HCV H77 | 47 | A0201 | 8 | TILELGQSL | 8398 | 44.56 |
| 492 | HCV H77 | 47 | A0201 | 8 | TILELGQSLV | 8399 | 145.08 |
| 493 | HCV H77 | 47 | A24 | 8 | TILELGQSL | 8400 | 10.37 |
| 494 | HCV H77 | 47 | B4403 | 10 | LELGQSLVT | 8401 | 12 |
| 495 | HCV H77 | 47 | B4403 | 10 | LELGQSLVTW | 8402 | 54 |
| 496 | HCV H77 | 47 | B7 | 4 | AASYTILEL | 8403 | 36 |
| 497 | HCV H77 | 47 | B7 | 2 | ASAASYTIL | 8404 | 12 |
| 498 | HCV H77 | 47 | B7 | 1 | MASAASYTIL | 8405 | 12 |
| 499 | HCV H77 | 47 | B7 | 3 | SAASYTILEL | 8406 | 12 |
| 500 | HCV H77 | 48 | A24 | 8 | KPHVRVSMTL | 8407 | 11.2 |
| 501 | HCV H77 | 48 | A68.1 | 13 | VSMTLPKLR | 8408 | 30 |
| 502 | HCV H77 | 48 | A68.1 | 26 | GSVGPQLGR | 8409 | 30 |
| 503 | HCV H77 | 48 | A68.1 | 12 | RVSMTLPKLR | 8410 | 200 |
| 504 | HCV H77 | 48 | A68.1 | 15 | MTLPKLRDLR | 8411 | 150 |
| 505 | HCV H77 | 48 | A68.1 | 10 | HVRVSMTLPK | 8412 | 120 |
| 506 | HCV H77 | 48 | A68.1 | 31 | QLGREPRGDR | 8413 | 10 |
| 507 | HCV H77 | 48 | B3501 | 42 | HPAHPQPSL | 8414 | 20 |
| 508 | HCV H77 | 48 | B3501 | 8 | KPHVRVSMTL | 8415 | 40 |
| 509 | HCV H77 | 48 | B3501 | 6 | SAKPHVRVSM | 8416 | 18 |
| 510 | HCV H77 | 48 | B7 | 42 | HPAHPQPSL | 8417 | 120 |
| 511 | HCV H77 | 48 | B7 | 12 | RVSMTLPKL | 8418 | 20 |
| 512 | HCV H77 | 48 | B7 | 8 | KPHVRVSMTL | 8419 | 80 |
| 513 | HCV H77 | 48 | B7 | 35 | EPRGDRSHPA | 8420 | 20 |
| 514 | HCV H77 | 48 | B7 | 2 | YPMRSAKPHV | 8421 | 12 |
| 515 | HCV H77 | 48 | B8 | 35 | EPRGDRSHPA | 8422 | 32 |
| 516 | HCV H77 | 48 | B8 | 19 | KLRDLRRGSV | 8423 | 18 |
| 517 | HCV H77 | 49 | A0201 | 22 | GLSRPNTTRL | 8424 | 21.36 |
| 518 | HCV H77 | 49 | A24 | 15 | PYQAVPQGL | 8425 | 50.4 |
| 519 | HCV H77 | 49 | A24 | 25 | RPNTTRLAVL | 8426 | 12 |
| 520 | HCV H77 | 49 | A3 | 22 | GLSRPNTTR | 8427 | 18 |
| 521 | HCV H77 | 49 | A3 | 33 | VLRGHAQISR | 8428 | 12 |
| 522 | HCV H77 | 49 | A68.1 | 27 | NTTRLAVLR | 8429 | 50 |
| 523 | HCV H77 | 49 | A68.1 | 17 | QAVPQGLSR | 8430 | 15 |
| 524 | HCV H77 | 49 | A68.1 | 16 | YQAVPQGLSR | 8431 | 10 |
| 525 | HCV H77 | 49 | B3501 | 8 | LPGHSQAPY | 8432 | 40 |
| 526 | HCV H77 | 49 | B3501 | 23 | LSRPNTTRL | 8433 | 15 |
| 527 | HCV H77 | 49 | B3501 | 25 | RPNTTRLAVL | 8434 | 40 |
| 528 | HCV H77 | 49 | B3501 | 14 | APYQAVPQGL | 8435 | 20 |
| 529 | HCV H77 | 49 | B7 | 23 | LSRPNTTRL | 8436 | 40 |
| 530 | HCV H77 | 49 | B7 | 14 | APYQAVPQGL | 8437 | 240 |
| 531 | HCV H77 | 49 | B7 | 25 | RPNTTRLAVL | 8438 | 80 |
| 532 | HCV H77 | 50 | A0201 | 2 | RLTDLSQLA | 8439 | 20.37 |
| 533 | HCV H77 | 50 | A0201 | 2 | RLTDLSQLAV | 8440 | 285.16 |
| 534 | HCV H77 | 50 | A1 | 15 | KMEPPLKKGK | 8441 | 90 |
| 535 | HCV H77 | 50 | A24 | 49 | KWLKRPECL | 8442 | 12 |
| 536 | HCV H77 | 50 | A3 | 15 | KMEPPLKKGK | 8443 | 45 |
| 537 | HCV H77 | 50 | A68.1 | 5 | DLSQLAVTR | 8444 | 15 |
| 538 | HCV H77 | 50 | A68.1 | 17 | EPPLKKGKR | 8445 | 15 |
| 539 | HCV H77 | 50 | B3501 | 61 | SSVGEEVDAY | 8446 | 15 |
| 540 | HCV H77 | 50 | B4403 | 65 | EEVDAYPCS | 8447 | 12 |
| 541 | HCV H77 | 50 | B4403 | 61 | SSVGEEVDAY | 8448 | 54 |
| 542 | HCV H77 | 50 | B7 | 11 | VTRAKMEPPL | 8449 | 40 |
| 543 | HCV H77 | 51 | A0201 | 32 | FELCSYCPV | 8450 | 34.53 |

TABLE 4n-continued

H77 (4-6)

| No | Strain | ORF | HLA | Start | Sequence | SEQ ID NO: | Score |
|---|---|---|---|---|---|---|---|
| 544 | HCV H77 | 51 | A1 | 29 | WSEFELCSY | 8451 | 67.5 |
| 545 | HCV H77 | 51 | A24 | 36 | SYCPVEEVL | 8452 | 336 |
| 546 | HCV H77 | 51 | A24 | 27 | RYWSEFELC | 8453 | 12 |
| 547 | HCV H77 | 51 | A24 | 75 | KFSEACGHPI | 8454 | 12 |
| 548 | HCV H77 | 51 | A24 | 27 | RYWSEFELCS | 8455 | 10 |
| 549 | HCV H77 | 51 | A68.1 | 7 | NVSPAVASR | 8456 | 300 |
| 550 | HCV H77 | 51 | A68.1 | 64 | PVSPSSQGR | 8457 | 30 |
| 551 | HCV H77 | 51 | A68.1 | 19 | GQVQPASGR | 8458 | 10 |
| 552 | HCV H77 | 51 | A68.1 | 42 | EVLATYGSPA | 8459 | 24 |
| 553 | HCV H77 | 51 | A68.1 | 63 | GPVSPSSQGR | 8460 | 10 |
| 554 | HCV H77 | 51 | B3501 | 38 | CPVEEVLATY | 8461 | 80 |
| 555 | HCV H77 | 51 | B4403 | 41 | EEVLATYGS | 8462 | 18 |
| 556 | HCV H77 | 51 | B4403 | 77 | SEACGHPIDF | 8463 | 160 |
| 557 | HCV H77 | 51 | B4403 | 38 | CPVEEVLATY | 8464 | 13.5 |
| 558 | HCV H77 | 51 | B4403 | 15 | REPTGQVQPA | 8465 | 12 |
| 559 | HCV H77 | 51 | B4403 | 59 | ADAPGPVSPS | 8466 | 12 |
| 560 | HCV H77 | 51 | B7 | 25 | SGRYWSEFEL | 8467 | 40 |
| 561 | HCV H77 | 53 | B3501 | 8 | RPQCGGKHDY | 8468 | 80 |
| 562 | HCV H77 | 54 | A1 | 2 | ATDVFCPIAK | 8469 | 125 |
| 563 | HCV H77 | 54 | A24 | 5 | VFCPIAKLGF | 8470 | 12 |
| 564 | HCV H77 | 54 | A68.1 | 4 | DVFCPIAKL | 8471 | 24 |
| 565 | HCV H77 | 54 | A68.1 | 2 | ATDVFCPIAK | 8472 | 30 |
| 566 | HCV H77 | 54 | B7 | 4 | DVFCPIAKL | 8473 | 30 |
| 567 | HCV H77 | 55 | B7 | 2 | WGRQAASFL | 8474 | 40 |
| 568 | HCV H77 | 56 | A0201 | 13 | FLLPLASTA | 8475 | 84.56 |
| 569 | HCV H77 | 56 | A0201 | 5 | NLQSVKCDFL | 8476 | 57.57 |
| 570 | HCV H77 | 56 | A0201 | 6 | LQSVKCDFLL | 8477 | 21.36 |
| 571 | HCV H77 | 56 | A68.1 | 2 | AVQNLQSVK | 8478 | 120 |
| 572 | HCV H77 | 56 | B7 | 8 | SVKCDFLLPL | 8479 | 20 |
| 573 | HCV H77 | 57 | A0201 | 6 | FVVRLFPRL | 8480 | 16.34 |
| 574 | HCV H77 | 57 | A24 | 5 | WFVVRLFPRL | 8481 | 43.2 |
| 575 | HCV H77 | 57 | B7 | 6 | FVVRLFPRL | 8482 | 20 |
| 576 | HCV H77 | 58 | A68.1 | 16 | ASRGAGHRR | 8483 | 15 |
| 577 | HCV H77 | 58 | A68.1 | 1 | MVGGASCLER | 8484 | 400 |
| 578 | HCV H77 | 58 | A68.1 | 14 | QLASRGAGHR | 8485 | 15 |
| 579 | HCV H77 | 59 | A0201 | 9 | RQHGYVRFGL | 8486 | 12.56 |
| 580 | HCV H77 | 59 | A1 | 4 | ISEHGRQHGY | 8487 | 67.5 |
| 581 | HCV H77 | 59 | A24 | 9 | RQHGYVRFGL | 8488 | 11.2 |
| 582 | HCV H77 | 59 | B4403 | 5 | SEHGRQHGY | 8489 | 360 |
| 583 | HCV H77 | 59 | B4403 | 5 | SEHGRQHGYV | 8490 | 12 |
| 584 | HCV H77 | 60 | A0201 | 48 | KVAQHLAYPV | 8491 | 21.3 |
| 585 | HCV H77 | 60 | A3 | 46 | GLKVAQHLAY | 8492 | 24 |
| 586 | HCV H77 | 60 | A68.1 | 40 | ELGFQPGLK | 8493 | 18 |
| 587 | HCV H77 | 60 | A68.1 | 27 | LAGHKGNPR | 8494 | 10 |
| 588 | HCV H77 | 60 | A68.1 | 26 | ALAGHKGNPR | 8495 | 10 |
| 589 | HCV H77 | 60 | B3501 | 33 | NPRQLWHEL | 8496 | 60 |
| 590 | HCV H77 | 60 | B3501 | 44 | QPGLKVAQHL | 8497 | 20 |
| 591 | HCV H77 | 60 | B3501 | 18 | SSPDPPIPAL | 8498 | 10 |
| 592 | HCV H77 | 60 | B4403 | 39 | HELGFQPGL | 8499 | 12 |
| 593 | HCV H77 | 60 | B7 | 33 | NPRQLWHEL | 8500 | 800 |
| 594 | HCV H77 | 60 | B7 | 19 | SPDPPIPAL | 8501 | 36 |
| 595 | HCV H77 | 60 | B7 | 44 | QPGLKVAQHL | 8502 | 80 |
| 596 | HCV H77 | 60 | B7 | 28 | AGHKGNPRQL | 8503 | 12 |
| 597 | HCV H77 | 60 | B8 | 33 | NPRQLWHEL | 8504 | 16 |
| 598 | HCV H77 | 61 | A24 | 14 | EYGSDAGGCI | 8505 | 50 |
| 599 | HCV H77 | 61 | A68.1 | 18 | DAGGCIALR | 8506 | 30 |
| 600 | HCV H77 | 61 | A68.1 | 22 | CIALRHVVR | 8507 | 10 |
| 601 | HCV H77 | 61 | A68.1 | 21 | GCIALRHVVR | 8508 | 10 |
| 602 | HCV H77 | 61 | B4403 | 5 | QELGYSEAA | 8509 | 12 |
| 603 | HCV H77 | 61 | B4403 | 13 | AEYGSDAGGC | 8510 | 18 |
| 604 | HCV H77 | 61 | B4403 | 10 | SEAAEYGSDA | 8511 | 16 |
| 605 | HCV H77 | 62 | A0201 | 16 | LLSEHHPLL | 8512 | 148.9 |
| 606 | HCV H77 | 62 | A0201 | 5 | GLQEAEGLL | 8513 | 11.39 |
| 607 | HCV H77 | 62 | A0201 | 5 | GLQEAEGLLL | 8514 | 87.59 |
| 608 | HCV H77 | 62 | A24 | 4 | RGLQEAEGL | 8515 | 12 |
| 609 | HCV H77 | 62 | A24 | 4 | RGLQEAEGLL | 8516 | 12 |
| 610 | HCV H77 | 62 | B4403 | 9 | AEGLLLELL | 8517 | 12 |
| 611 | HCV H77 | 62 | B4403 | 18 | SEHHPLLDV | 8518 | 12 |
| 612 | HCV H77 | 62 | B4403 | 7 | QEAEGLLLEL | 8519 | 12 |
| 613 | HCV H77 | 63 | A0201 | 37 | KVLPTLLCL | 8520 | 55.67 |
| 614 | HCV H77 | 63 | A0201 | 29 | GLVRYQVRKV | 8521 | 31.99 |
| 615 | HCV H77 | 63 | A0201 | 33 | YQVRKVLPTL | 8522 | 22.92 |
| 616 | HCV H77 | 63 | A24 | 37 | KVLPTLLCL | 8523 | 14.4 |
| 617 | HCV H77 | 63 | A24 | 32 | RYQVRKVLPT | 8524 | 15 |
| 618 | HCV H77 | 63 | A3 | 29 | GLVRYQVRK | 8525 | 270 |

TABLE 4n-continued

H77 (4-6)

| No | Strain | ORF | HLA | Start | Sequence | SEQ ID NO: | Score |
|---|---|---|---|---|---|---|---|
| 619 | HCV H77 | 63 | A68.1 | 9 | QTLPHLVPR | 8526 | 150 |
| 620 | HCV H77 | 63 | A68.1 | 37 | KVLPTLLCL | 8527 | 12 |
| 621 | HCV H77 | 63 | A68.1 | 8 | DQTLPHLVPR | 8528 | 15 |
| 622 | HCV H77 | 63 | B4403 | 25 | SAHGGLVRY | 8529 | 13.5 |
| 623 | HCV H77 | 63 | B4403 | 1 | MEGGFKADQT | 8530 | 13.5 |
| 624 | HCV H77 | 63 | B7 | 34 | QVRKVLPTL | 8531 | 200 |
| 625 | HCV H77 | 63 | B7 | 14 | LVPRWGRGL | 8532 | 20 |
| 626 | HCV H77 | 63 | B7 | 37 | KVLPTLLCL | 8533 | 20 |
| 627 | HCV H77 | 63 | B7 | 30 | LVRYQVRKV | 8534 | 10 |
| 628 | HCV H77 | 63 | B7 | 30 | LVRYQVRKVL | 8535 | 300 |
| 629 | HCV H77 | 63 | B7 | 34 | QVRKVLPTLL | 8536 | 200 |
| 630 | HCV H77 | 64 | A0201 | 8 | ALPKFKMVL | 8537 | 33.28 |
| 631 | HCV H77 | 64 | A0201 | 15 | VLAHGKPRGV | 8538 | 23.65 |
| 632 | HCV H77 | 64 | A0201 | 8 | ALPKFKMVLA | 8539 | 11.43 |
| 633 | HCV H77 | 64 | A68.1 | 14 | MVLAHGKPR | 8540 | 400 |
| 634 | HCV H77 | 64 | A68.1 | 13 | KMVLAHGKPR | 8541 | 10 |
| 635 | HCV H77 | 64 | B3501 | 20 | KPRGVHVRS | 8542 | 12 |
| 636 | HCV H77 | 64 | B7 | 8 | ALPKFKMVL | 8543 | 12 |
| 637 | HCV H77 | 64 | B7 | 7 | DALPKFKMVL | 8544 | 12 |
| 638 | HCV H77 | 64 | B8 | 9 | LPKFKMVLA | 8545 | 16 |
| 639 | HCV H77 | 65 | A0201 | 72 | VALVTNYYV | 8546 | 33.42 |
| 640 | HCV H77 | 65 | A0201 | 71 | GVALVTNYYV | 8547 | 33.47 |
| 641 | HCV H77 | 65 | A1 | 7 | HLEGDSLAVK | 8548 | 36 |
| 642 | HCV H77 | 65 | A3 | 7 | HLEGDSLAVK | 8549 | 45 |
| 643 | HCV H77 | 65 | A68.1 | 42 | SSGEHNQSR | 8550 | 30 |
| 644 | HCV H77 | 65 | A68.1 | 31 | RMGHSDGAR | 8551 | 15 |
| 645 | HCV H77 | 65 | A68.1 | 62 | DAQDGCGIR | 8552 | 15 |
| 646 | HCV H77 | 65 | A68.1 | 41 | GSSGEHNQSR | 8553 | 15 |
| 647 | HCV H77 | 65 | A68.1 | 29 | DVRMGHSDGA | 8554 | 12 |
| 648 | HCV H77 | 65 | A68.1 | 31 | RMGHSDGARR | 8555 | 10 |
| 649 | HCV H77 | 65 | B3501 | 48 | QSRPRSLCL | 8556 | 15 |
| 650 | HCV H77 | 65 | B3501 | 24 | QSNLLDVRM | 8557 | 10 |
| 651 | HCV H77 | 65 | B4403 | 70 | RGVALVTNY | 8558 | 27 |
| 652 | HCV H77 | 65 | B4403 | 70 | RGVALVTNYY | 8559 | 13.5 |
| 653 | HCV H77 | 65 | B7 | 48 | QSRPRSLCL | 8560 | 40 |
| 654 | HCV H77 | 65 | B8 | 48 | QSRPRSLCL | 8561 | 80 |
| 655 | HCV H77 | 65 | B8 | 66 | GCGIRGVAL | 8562 | 16 |
| 656 | HCV H77 | 66 | A0201 | 51 | ALGHCWWRGV | 8563 | 23.65 |
| 657 | HCV H77 | 66 | A0201 | 43 | SMQVGHLEAL | 8564 | 17.39 |
| 658 | HCV H77 | 66 | A68.1 | 50 | EALGHCWWR | 8565 | 30 |
| 659 | HCV H77 | 66 | A68.1 | 22 | HLVALGCVR | 8566 | 10 |
| 660 | HCV H77 | 66 | A68.1 | 24 | VALGCVRSR | 8567 | 10 |
| 661 | HCV H77 | 66 | A68.1 | 23 | LVALGCVRSR | 8568 | 400 |
| 662 | HCV H77 | 66 | A68.1 | 7 | STKAQRCSNR | 8569 | 50 |
| 663 | HCV H77 | 66 | B4403 | 49 | LEALGHCWW | 8570 | 24 |
| 664 | HCV H77 | 66 | B7 | 28 | CVRSRDLGAL | 8571 | 200 |
| 665 | HCV H77 | 66 | B7 | 14 | SNRGVEHQL | 8572 | 40 |
| 666 | HCV H77 | 66 | B7 | 25 | ALGCVRSRDL | 8573 | 12 |
| 667 | HCV H77 | 66 | B7 | 40 | AGGSMQVGHL | 8574 | 12 |
| 668 | HCV H77 | 67 | A68.1 | 1 | MVIHIGASK | 8575 | 240 |
| 669 | HCV H77 | 67 | A68.1 | 1 | MVIHIGASKR | 8576 | 400 |
| 670 | HCV H77 | 69 | A68.1 | 14 | VAHPSDDTR | 8577 | 11.25 |
| 671 | HCV H77 | 69 | A68.1 | 13 | VVAHPSDDTR | 8578 | 600 |
| 672 | HCV H77 | 69 | B4403 | 9 | AEQGVVAHPS | 8579 | 27 |
| 673 | HCV H77 | 69 | B4403 | 19 | DDTRGRSAHF | 8580 | 15 |
| 674 | HCV H77 | 70 | A0201 | 59 | KLRCGEFAV | 8581 | 107.3 |
| 675 | HCV H77 | 70 | A0201 | 52 | KQIDMTSKL | 8582 | 31.08 |
| 676 | HCV H77 | 70 | A1 | 44 | RAEGGAPDK | 8583 | 36 |
| 677 | HCV H77 | 70 | A24 | 52 | KQIDMTSKL | 8584 | 15.84 |
| 678 | HCV H77 | 70 | A24 | 3 | RYMAGIDRT | 8585 | 15 |
| 679 | HCV H77 | 70 | A24 | 3 | RYMAGIDRTI | 8586 | 210 |
| 680 | HCV H77 | 70 | A24 | 93 | RSVQDGIGRL | 8587 | 12 |
| 681 | HCV H77 | 70 | A68.1 | 18 | PVAPGREGK | 8588 | 36 |
| 682 | HCV H77 | 70 | A68.1 | 93 | RSVQDGIGR | 8589 | 30 |
| 683 | HCV H77 | 70 | A68.1 | 36 | AQVPHVEGR | 8590 | 15 |
| 684 | HCV H77 | 70 | A68.1 | 26 | KQLTNKKDR | 8591 | 10 |
| 685 | HCV H77 | 70 | A68.1 | 101 | RLVHNTRVR | 8592 | 10 |
| 686 | HCV H77 | 70 | A68.1 | 111 | IIGDMVKPR | 8593 | 10 |
| 687 | HCV H77 | 70 | A68.1 | 1 | MTRYMAGIDR | 8594 | 50 |
| 688 | HCV H77 | 70 | A68.1 | 67 | VPGGHRGGHR | 8595 | 15 |

TABLE 4n-continued

H77 (4-6)

| No | Strain | ORF | HLA | Start | Sequence | SEQ ID NO: | Score |
|---|---|---|---|---|---|---|---|
| 689 | HCV H77 | 70 | A68.1 | 84 | TLANARDTPR | 8596 | 15 |
| 690 | HCV H77 | 70 | A68.1 | 52 | KQIDMTSKLR | 8597 | 10 |
| 691 | HCV H77 | 70 | A68.1 | 98 | GIGRLVHNTR | 8598 | 10 |
| 692 | HCV H77 | 70 | A68.1 | 110 | AIIGDMVKPR | 8599 | 10 |
| 693 | HCV H77 | 70 | B3501 | 20 | APGREGKQL | 8600 | 30 |
| 694 | HCV H77 | 70 | B3501 | 117 | KPRGIAHLV | 8601 | 24 |
| 695 | HCV H77 | 70 | B3501 | 91 | TPRSVQDGI | 8602 | 24 |
| 696 | HCV H77 | 70 | B3501 | 77 | HPTPRGVTL | 8603 | 20 |
| 697 | HCV H77 | 70 | B3501 | 57 | TSKLRCGEF | 8604 | 15 |
| 698 | HCV H77 | 70 | B3501 | 107 | RVRAIIGDM | 8605 | 12 |
| 699 | HCV H77 | 70 | B3501 | 48 | GAPDKQIDM | 8606 | 12 |
| 700 | HCV H77 | 70 | B3501 | 93 | RSVQDGIGRL | 8607 | 10 |
| 701 | HCV H77 | 70 | B4403 | 45 | AEGGAPDKQI | 8608 | 18 |
| 702 | HCV H77 | 70 | B7 | 20 | APGREGKQL | 8609 | 240 |
| 703 | HCV H77 | 70 | B7 | 77 | HPTPRGVTL | 8610 | 80 |
| 704 | HCV H77 | 70 | B7 | 91 | TPRSVQDGI | 8611 | 80 |
| 705 | HCV H77 | 70 | B7 | 107 | RVRAIIGDM | 8612 | 50 |
| 706 | HCV H77 | 70 | B7 | 117 | KPRGIAHLV | 8613 | 40 |
| 707 | HCV H77 | 70 | B7 | 94 | SVQDGIGRL | 8614 | 20 |
| 708 | HCV H77 | 70 | B7 | 79 | TPRGVTLANA | 8615 | 20 |
| 709 | HCV H77 | 70 | B7 | 115 | MVKPRGIAHL | 8616 | 20 |
| 710 | HCV H77 | 70 | B7 | 6 | AGIDRTIAVL | 8617 | 12 |
| 711 | HCV H77 | 70 | B7 | 19 | VAPGREGKQL | 8618 | 12 |
| 712 | HCV H77 | 70 | B7 | 107 | RVRAIIGDMV | 8619 | 10 |
| 713 | HCV H77 | 70 | B8 | 77 | HPTPRGVTL | 8620 | 16 |
| 714 | HCV H77 | 70 | B8 | 29 | TNKKDRPAQV | 8621 | 12 |

Example 1.2

Immunogenicity of ncHCV Peptides According to the Present Invention

To determine if the peptides provided with the present invention are potentially immunogenic, three peptides from HCV 1b for the HLA-A*0201 allele were chosen and HLA-A*0201 transgenic mice (HHD) vaccinated therewith.

Example 1.2.1

Vaccination of Mice with ncORFs According to the Present Invention (Ipep 1371, Ipep 1372, Ipep 1373)

HLA-A*0201-transgenic mice (5 per group) were vaccinated subcutaneously as follows:

1) 1371 (HCV-H77 ncORF(1-3)11 TLWAGPLLKV-SEQ ID NO: 823) + CpG 1668

2) 1372 (HCV-H77 ncORF(1-3)13 LLLQRWALV-SEQ ID NO: 824) + CpG 1668

3) 1373 (HCV-H77 ncORF(1-3)27 FMLGALLPI-SEQ ID NO: 825) + CpG 1668

7 days after the vaccination draining lymph nodes were removed and the cells were activated ex vivo with peptides to determine the number of IFN-g-producing peptide-specific T cells (Elispot assay). As can be seen in FIG. 1, all peptides induce high numbers of peptide-specific T cells ("Background" means "Medium Control", i.e. cells cultured without peptide).

Example 1.2.2

Vaccination of Mice with ncORFs According to the Present Invention (Ipep 1445, Ipep 1447)

HLA-A*0201-transgenic mice (5 per group) were vaccinated subcutaneously as follows:

1) 1445 (HCV-1b ncORF(1-3)36 RLLQLKYCV (SEQ ID NO: 826) + CpG 1668

2) 1447 (HCV-1b ncORF(1-3)36 FLYLPLSFAV (SEQ ID NO: 827) + CpG 1668

Figure 2:
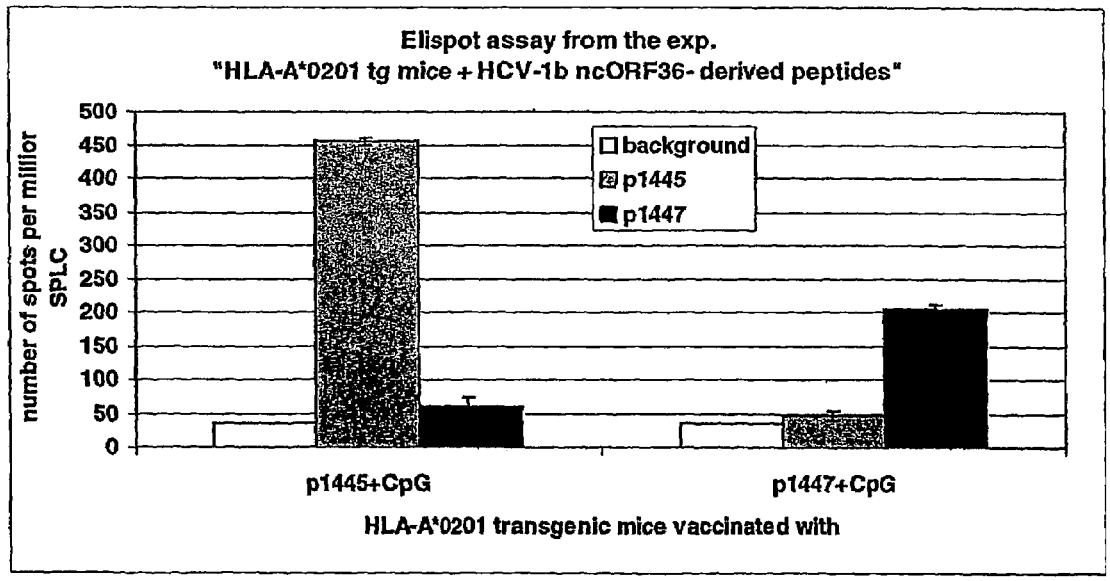
FIG. 2 shows the Elispot assay from the experiment with HLA-A*0201 tg mice+HCV-1b ncORF 36-derived peptides.

7 days after the vaccination spleens were removed and the cells were activated ex vivo with peptides to determine the number of IFN-g-producing peptide-specific T cells (Elispot assay). As can be seen in FIG. 2, both peptides induce high numbers of peptide-specific T cells ("Background" means "Medium Control", i.e. cells cultured without peptide).

Example 1.3

HCV Patient In Vivo Relevance of the ncHCV Peptides According to the Present Invention Since those ncORF peptides are immunogenic in tg-mice, the present peptides were ananlysed in an ELIspot assay on PBL's from HCV+ patients.

Example 1.3.1

Elispot with HCV patient-derived cells and with ncORFs according to the present invention (Ipep 1371, Ipep 1372, Ipep 1373)

The patient had a chronic HCV infection in 1992 that was cured under IFN-alpha mono-therapy from 1993 to 1994. Patient-derived peripheral blood mononuclear cells (PBMC) frozen in 1996 were thawed to perform an IFN-g Elispot assay with the following peptides:

```
1) 1371 (HCV-H77 ncORF(1-3)11   TLWAGPLLKV-SEQ ID NO: 823)

2) 1372 (HCV-H77 ncORF(1-3)13   LLLQRWALV-SEQ ID NO: 824)

3) 1373 (HCV-H77 ncORF(1-3)27   FMLGALLPI-SEQ ID NO: 825)

4) 1006 (HCV-derived)           MWNFISGIQYLAGLSTLPGN
                                (SEQ ID NO: 828)

5) 84 (HCV-derived)             GYKVLVLNPSVAAT
                                (SEQ ID NO: 829)

6) CMV pp65                     NLVPMVATV

7) Influenza A Matrix           GILGFVFTL
   (aa58-67)
```

Figure 3:
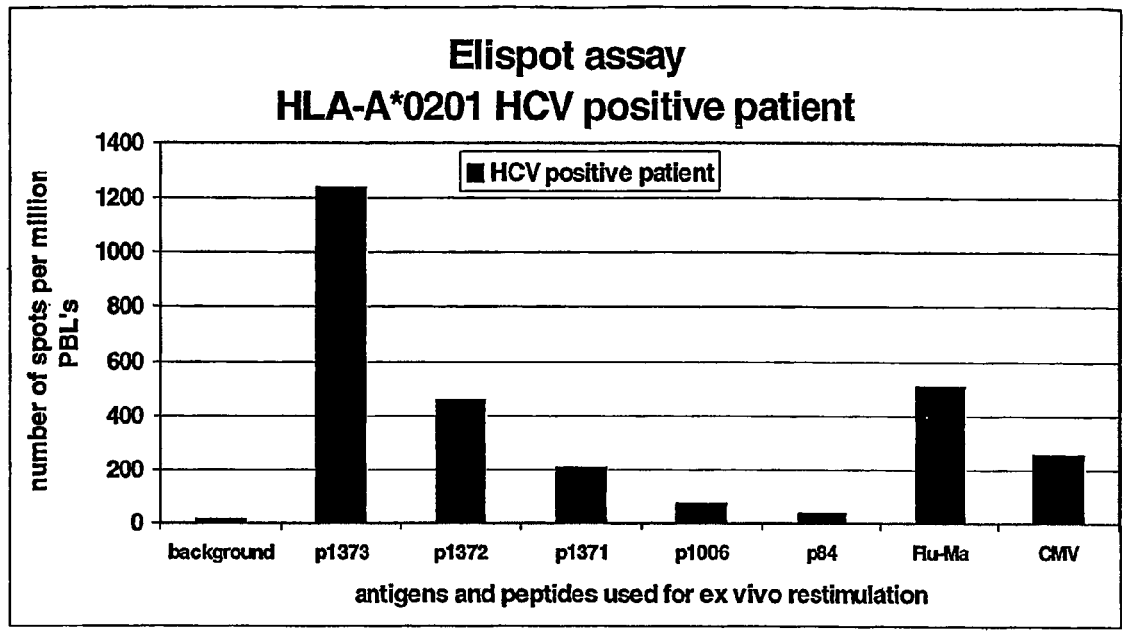
FIG. 3 shows an Elispot assay for an HLA-A*0201 HCV positive patient

As can be seen in Table 5 and FIG. 3, the peptides 1371, 1372, and 1373 as well as the positive control peptides (CMV-derived, Influenza-derived) induce high numbers of peptide-specific T cells.

TABLE 5

ELIspot results
ELISPOT-resuls Patient MRG Plate 11_01_03

| Peptide | Counts-mean size >10 | Counts-mean size >25 | Counts-mean size >75 |
|---|---|---|---|
| 1373 | 159 | 86 | 3 |
| 1372 | 43 | 36 | 13 |
| 1371 | 24 | 15 | 2 |
| Medium-control | 2 | 1 | 0 |
| PHA | Confluent | Confluent | Confluent |
| Flu-Ma | 48 | 36 | 17 |
| CMV | 28 | 17 | 6 |

Example 1.4

Peptides from Reading Frames 4 to 6 are Immunogenic in Transgenic Mice (Ipep 1490, Ipep 1491; Ipep 1492; Ipep 1493; Ipep 1494, Ipep 82) HLA-A*0201-transgenic mice (5 per group) were vaccinated subcutaneously as follows:

```
1) 1490 (HCV-1b ncORF(4-6) KMLNRRVLWV-SEQ ID
   NO: 830) + CpG 1668

2) 1491 (HCV-1b ncORF(4-6) VLLMCQLPLV-SEQ ID
   NO: 831) + CpG 1668

3) 1492 (HCV-1b ncORF(4-6) MLNRRVLWVV-SEQ ID
   NO: 832) + CpG 1668

4) 1493 (HCV-1b ncORF(4-6) TILELEQSFV-SEQ ID
   NO: 833) + CpG 1668

5) 1494 (HCV-1b ncORF(4-6) KMMSPHAAV-SEQ ID
   NO: 834) + CpG 1668

6) 82 (EBV, control GLCTLVAML-SEQ ID NO:
   1038) + CpG 1668
```

Figure 4:
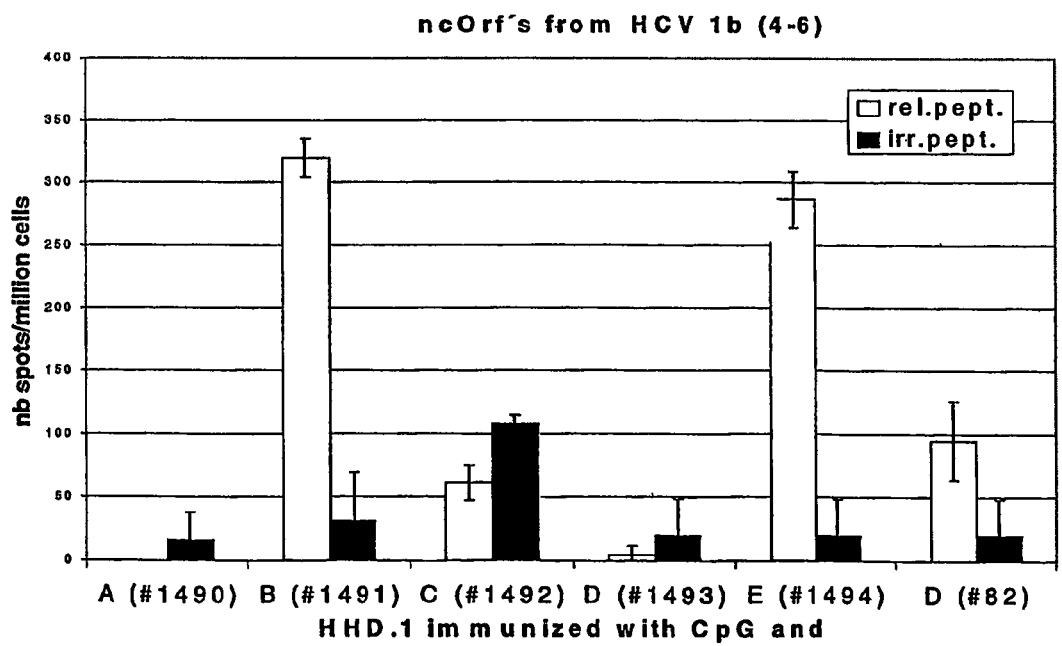
FIG. 4 shows the immunogenicity of peptides from HCV 1b reading frames 4 to 6 in transgenic mice

7 days after the vaccination spleens were removed and the cells were activated ex vivo with peptides to determine the number of IFN-g-producing peptide-specific T cells (Elispot assay). As can be seen in FIG. 4, two of the four peptides (#1491, #1494) induce high numbers of peptide-specific T cells.

With the present HCV model according to example 1, it could be clearly demonstrated that within different ORFs of a viral genome possible encoded CTL epitopes may be identified, peptides of those ORF's are immunogenic in tg-mice, especially also in reading frames 4 to 6 and give positive ELIspot results in HCV+ patients, i.e. are relevant pathological parameters in HCV infections.

Example 2

HIV

In the present example, the genome of HIV was analysed according to the present invention with respect to its non coding ORFs. The results are depicted in table 6. From there the HIV-ncORFs with a minimum length of 7 amino acid residues or those being longer than 7 amino acid residues are deriveable which may preferably be used as antigens for the preparation of a HIV vaccine.

More preferred, ORFs having a minimum length of 9 amino acid residues are selected from table 6, especially if they are T-cell antigens, B-cell antigens or both.

The HIV-ORFs are therefore preferably selected from ORF-Nos. 13, 23, 27, 69 and 80 in Table 6.

TABLE 6

| No. Seq of Id. | ORF | Start | Stop | Sequence | Length |
|---|---|---|---|---|---|
|  | 1 | 336 | 1874 | GAG-sequence |  |
| 835 | 2 | 380 | 424 | MGKNSVKARGKEKI | 14 |
| 836 | 3 | 440 | 474 | MGKQGARTIRS | 11 |
| 837 | 4 | 793 | 804 | MHG | 3 |
| 838 | 6 | 952 | 1020 | MRKLQNGIECIQCMQGLLHQAR | 22 |
| 839 | 7 | 968 | 976 | MG | 2 |
| 840 | 8 | 1079 | 1093 | MDDK | 4 |
| 841 | 9 | 1127 | 1150 | MDNPGIK | 7 |
|  | 10 | 1222 | 1227 | M | 1 |
| 842 | 11 | 1309 | 1338 | MRTQIVRLF | 9 |
| 843 | 12 | 1382 | 1411 | MSGSGRTRP | 9 |
| 844 | 13 | 1580 | 1618 | MWKGRTPNERLY | 12 |
|  | 14 | 1631 | 4674 | POL-sequence (no Initiation Meth.) |  |
| 845 | 15 | 1920 | 1934 | MIQY | 4 |
|  | 16 | 1940 | 4674 | POL-sequence |  |
| 846 | 17 | 1957 | 2013 | METKNDRGNWRFYQSKTV | 18 |
| 847 | 18 | 2010 | 2027 | MIRYS | 5 |

TABLE 6-continued

| No. Seq of Id. | ORF | Start | Stop | Sequence | Length |
|---|---|---|---|---|---|
| 848 | 19 | 2181 | 2209 | MAQKLNNGN | 9 |
| 849 | 20 | 2200 | 2289 | MAIDRRKNKSISRNLYRNGKGRENFKNWA | 29 |
| 850 | 21 | 2341 | 2373 | MEKISRFQRT | 10 |
| 851 | 22 | 2460 | 2492 | MWVNHIFQFP | 10 |
| 852 | 23 | 2493 | 2537 | MKTSGSILHLPYLV | 14 |
| 853 | 24 | 2541 | 2624 | MRHQGLDISTMCFHRDGKDHQQYSKVA | 27 |
| 854 | 25 | 2685 | 2699 | MICM | 4 |
| 855 | 26 | 2826 | 2864 | MNSILINGQYSL | 12 |
| 856 | 27 | 2845 | 2898 | MDSTAYSAARKRQLDCQ | 17 |
| 857 | 28 | 2895 | 2912 | MTYRS | 5 |
|  | 29 | 2968 | 2973 | M | 1 |
| 858 | 30 | 3075 | 3106 | MECIMTHQKT | 10 |
| 859 | 31 | 3139 | 3171 | MDISNLSRAI | 10 |
| 860 | 32 | 3192 | 3227 | MQERGVPTLMM | 11 |
| 861 | 33 | 3277 | 3294 | MGKDS | 5 |
| 862 | 34 | 3322 | 333369 | MGNMVDRVLASHLDS | 15 |
| 863 | 35 | 3406 | 3471 | MVPVRERTHSRSRNVLCRWGS | 21 |
|  | 36 | 3453 | 3458 | M | 1 |
| 864 | 37 | 3459 | 3488 | MGQLAGRLN | 9 |
| 865 | 38 | 3501 | 3539 | MLLIEEDKKLSP | 12 |
| 866 | 39 | 3633 | 3640 | MH | 2 |
| 867 | 40 | 3733 | 3768 | MGTSTQRNWRK | 11 |
| 868 | 41 | 3765 | 3776 | MNK | 3 |
| 869 | 42 | 3819 | 3827 | ME | 2 |
| 870 | 43 | 3840 | 3905 | MNMRNITVIGEQWLVILTCHL | 21 |
| 871 | 44 | 3937 | 3981 | MSAKRRSHAWTSRL | 14 |
| 872 | 45 | 3963 | 3974 | MDK | 3 |
| 873 | 46 | 3991 | 4191 | MATRLYTFRRKSYPGSSSCSQWIYRSRSYSSRNRAGNSILSFKISRKMASKNNTYRQWQQFHQYYG | 66 |
|  | 47 | 4044 | 4049 | M | 1 |
|  | 49 | 4623 | 5190 | VIF-SEQUENCE |  |
| 874 | 50 | 4682 | 4729 | MEKFSKTPYVCFRES | 15 |
| 875 | 51 | 4711 | 4776 | MFQGKLGDGFIDITMKALIQE | 21 |
| 876 | 52 | 4733 | 4744 | MVL | 3 |
| 877 | 53 | 4804 | 4818 | MLDW | 4 |
| 878 | 54 | 4886 | 4906 | MEEKEI | 6 |
|  | 55 | 5141 | 5427 | VPR-SEQUENCE |  |
| 879 | 56 | 5191 | 5220 | MDTRAFRGA | 9 |
| 880 | 57 | 5223 | 5267 | MKLLDIFLGFGSMA | 14 |
| 881 | 58 | 5280 | 5321 | MKLMGILGQEWKP | 13 |
|  | 59 | 5412 | 5626 | TAT-1-SEQUENCE |  |
|  | 60 | 5551 | 5626 | REV-1-SEQUENCE |  |
|  | 61 | 5638 | 5643 | M | 1 |
|  | 62 | 5643 | 5884 | VPU-SEQUENCE |  |
|  | 63 | 5803 | 8384 | ENV-SEQUENCE |  |
|  | 65 | 6065 | 6070 | M | 1 |
| 882 | 66 | 6095 | 6107 | MTW | 3 |
| 883 | 67 |  |  | MGSKPKAMCKINPT | 14 |
| 884 | 68 |  |  | MRI | 3 |
| 885 | 69 | 6209 | 6259 | MLLIPIVVIPIVVAGK | 16 |
| 886 | 70 | 6335 | 6361 | MHFINLI | 8 |
| 887 | 71 | 6374 | 6397 | MILPAIR | 7 |
|  | 72 | 6498 | 6503 | M | 1 |
| 888 | 73 | 6518 | 6580 | MEQDHVQMSAQYNVHMELGQ | 20 |
| 889 | 74 | 6531 | 6572 | MYKCQHSTMYTWN | 13 |
| 890 | 75 | 6602 | 6613 | MAV | 3 |
| 891 | 76 | 6656 | 6670 | MLKP | 4 |
| 892 | 77 | 6828 | 6857 | MECHFKTDS | 9 |
| 893 | 78 | 6833 | 6844 | MPL | 3 |
| 894 | 79 | 7068 | 7148 | MQNKTIYKHVAGSRKSNVCPSHQRTN | 26 |
| 895 | 80 | 7121 | 7180 | MPLPSADKLDVHQILQGCY | 19 |
| 896 | 81 | 7148 | 7196 | MFIKYYRAAINKRWW | 15 |
| 897 | 82 | 7187 | 7243 | MVVITTMGPRSSDLEEEI | 18 |
| 898 | 83 | 7649 | 7696 | MLVGVINLWNRFGIT | 15 |
| 899 | 84 | 7784 | 7807 | MNKNYWN | 7 |
| 900 | 85 | 7812 | 7838 | MGKEVELV | 8 |
| 901 | 86 | 8264 | 8278 | MPQP | 4 |
|  | 87 | 8390 | 9006 | NEF-SEQUENCE |  |
| 902 | 88 | 8425 | 8460 | MAYCKGKNETS | 11 |
| 903 | 89 | 8472 | 8564 | MGWEQHLETWKNMEQSQVAIQQLPMLLVPG | 30 |
| 904 | 90 | 8809 | 8835 | MVLQASTS | 8 |
| 905 | 91 | 8901 | 8933 | MEWMTLREKC | 10 |
| 906 | 92 | 9097 | 9147 | MLHISS | 6 |

Non-coding HIV-ORFs=all ORFs, except GAG, POL, VIF, VPR, TAT, REV, VPU, ENV and NEF (ORF-Nos. 1, 14, 16, 49, 55, 59, 60, 62, 63 and 87 in Table 6)

HIV selected ORFs: ORF-Nos. 2, 3, 6, 9, 11, 12, 13, 17, 19, 20, 21, 22, 23, 24, 26, 27, 30, 31, 32, 34, 35, 37, 38, 40, 43, 44, 46, 48, 50, 56, 57, 58, 64, 67, 69, 70, 71, 73, 74, 77, 79, 80, 81, 82, 83, 84, 85, 88, 89, 90 and 91 in Table 6.

3. Human Papilloma Virus (HPV)

In this example, possible ncORF epitopes with superior immunisation properties of HPV are identified as in Example 1 for HCV epitopes. The results are depicted in the following table 7:

TABLE 7

| No | Species | Strain type | Frame | ORF | HLA | Seq | Seq ID No. | Score | Length |
|---|---|---|---|---|---|---|---|---|---|
| 1 | HPV | 16 | 1 | 2 | A68.1 | IVCPICSQK | 1045 | 180.00 | 9 |
| 2 | HPV | 16 | 1 | 3 | B*2705 | LQKGDYLK | 1046 | 200.00 | 8 |
| 3 | HPV | 16 | 1 | 3 | B*5102 | MAILKWKL | 1047 | 181.50 | 8 |
| 4 | HPV | 16 | 1 | 3 | B*5103 | KAKTAGMAI | 1048 | 133.10 | 9 |
| 5 | HPV | 16 | 1 | 3 | B*5102 | KAKTAGMAI | 1048 | 110.00 | 9 |
| 6 | HPV | 16 | 1 | 3 | A*0201 | GMAILKWKL | 1049 | 115.71 | 9 |
| 7 | HPV | 16 | 1 | 3 | Cw*0401 | DYLKAKTAGM | 1050 | 120.00 | 10 |
| 8 | HPV | 16 | 1 | 3 | B*5801 | KTAGMAILKW | 1051 | 348.48 | 10 |
| 9 | HPV | 16 | 1 | 3 | B62 | ILKWKLSRCY | 1052 | 312.00 | 10 |
| 10 | HPV | 16 | 1 | 4 | B*2705 | TLYAKHHL | 1053 | 150.00 | 8 |
| 11 | HPV | 16 | 1 | 4 | B*5102 | YAKHHLQI | 1054 | 242.00 | 8 |
| 12 | HPV | 16 | 1 | 4 | B*5102 | VGVVAVSTV | 1055 | 132.00 | 9 |
| 13 | HPV | 16 | 1 | 4 | B*5103 | VAVSTVVEV | 1056 | 121.00 | 9 |
| 14 | HPV | 16 | 1 | 4 | B*5102 | VAVSTVVEV | 1056 | 330.00 | 9 |
| 15 | HPV | 16 | 1 | 4 | A68.1 | STVVEVGER | 1057 | 100.00 | 9 |
| 16 | HPV | 16 | 1 | 4 | A68.1 | EVGERVLVK | 1058 | 720.00 | 9 |
| 17 | HPV | 16 | 1 | 4 | B14 | ERVLVKDTL | 1059 | 180.00 | 9 |
| 18 | HPV | 16 | 1 | 4 | B*2705 | ERVLVKDTL | 1059 | 200.00 | 9 |
| 19 | HPV | 16 | 1 | 4 | A68.1 | LVKDTLYAK | 1060 | 120.00 | 9 |
| 20 | HPV | 16 | 1 | 4 | B*5102 | VGVVAVSTVV | 1061 | 132.00 | 10 |
| 21 | HPV | 16 | 1 | 4 | B*5201 | VGVVAVSTVV | 1061 | 198.00 | 10 |
| 22 | HPV | 16 | 1 | 4 | B60 | GERVLVKDTL | 1062 | 176.00 | 10 |
| 23 | HPV | 16 | 1 | 4 | B*2705 | ERVLVKDTLY | 1063 | 100.00 | 10 |
| 24 | HPV | 16 | 1 | 4 | A3 | VLVKDTLYAK | 1064 | 135.00 | 10 |
| 25 | HPV | 16 | 1 | 4 | Cw*0401 | LYAKHHLQIF | 1065 | 220.00 | 10 |
| 26 | HPV | 16 | 1 | 4 | A24 | LYAKHHLQIF | 1065 | 120.00 | 10 |
| 27 | HPV | 16 | 1 | 5 | B*3901 | LHLDLHPV | 1066 | 120.00 | 8 |
| 28 | HPV | 16 | 1 | 6 | B*2705 | IRTGNPFS | 1067 | 200.00 | 8 |
| 29 | HPV | 16 | 1 | 6 | B*2705 | VQILGGLIY | 1068 | 100.00 | 9 |
| 30 | HPV | 16 | 1 | 6 | B62 | VQILGGLIY | 1068 | 192.00 | 9 |
| 31 | HPV | 16 | 1 | 6 | A*0201 | LIYIIDWWC | 1069 | 153.29 | 9 |
| 32 | HPV | 16 | 1 | 6 | A24 | IYIIDWWCL | 1070 | 300.00 | 9 |
| 33 | HPV | 16 | 1 | 6 | Cw*0401 | IYIIDWWCL | 1070 | 200.00 | 9 |
| 34 | HPV | 16 | 1 | 6 | B*3701 | IDWWCLHFL | 1071 | 200.00 | 9 |
| 35 | HPV | 16 | 1 | 6 | B*3901 | LHFLMSFHL | 1072 | 180.00 | 9 |
| 36 | HPV | 16 | 1 | 6 | A3 | FLMSFHLTK | 1073 | 180.00 | 9 |
| 37 | HPV | 16 | 1 | 6 | B*2705 | IQCMSLMIR | 1074 | 100.00 | 9 |
| 38 | HPV | 16 | 1 | 6 | A*0201 | GLIYIIDWWC | 1075 | 204.93 | 10 |
| 39 | HPV | 16 | 1 | 6 | A*0201 | LIYIIDWWCL | 1076 | 203.73 | 10 |
| 40 | HPV | 16 | 1 | 6 | A*0201 | CLHFLMSFHL | 1077 | 123.90 | 10 |
| 41 | HPV | 16 | 1 | 6 | A*0201 | FLMSFHLTKT | 1078 | 291.72 | 10 |
| 42 | HPV | 16 | 1 | 6 | A68.1 | RTGNPFSQGR | 1079 | 100.00 | 10 |
| 43 | HPV | 16 | 1 | 7 | B*5102 | KALQAIEL | 1080 | 199.65 | 8 |
| 44 | HPV | 16 | 1 | 7 | B*2705 | LQAIELQL | 1081 | 200.00 | 8 |
| 45 | HPV | 16 | 1 | 7 | B*2705 | VQFDGDIC | 1082 | 100.00 | 8 |
| 46 | HPV | 16 | 1 | 7 | B*2705 | GQVDYYGL | 1083 | 200.00 | 8 |
| 47 | HPV | 16 | 1 | 7 | B*5102 | EGIRTYFV | 1084 | 145.20 | 8 |
| 48 | HPV | 16 | 1 | 7 | B*2705 | IRTYFVQF | 1085 | 1000.00 | 8 |
| 49 | HPV | 16 | 1 | 7 | B*2705 | RTYFVQFK | 1086 | 150.00 | 8 |
| 50 | HPV | 16 | 1 | 7 | B*2705 | IRQHLANH | 1087 | 200.00 | 8 |
| 51 | HPV | 16 | 1 | 7 | B*5102 | AATHTKAV | 1088 | 121.00 | 8 |
| 52 | HPV | 16 | 1 | 7 | B*3901 | THTKAVAL | 1089 | 135.00 | 8 |
| 53 | HPV | 16 | 1 | 7 | B*5102 | NPCHTTKL | 1090 | 146.41 | 8 |
| 54 | HPV | 16 | 1 | 7 | B*2705 | HRDSVDSA | 1091 | 200.00 | 8 |
| 55 | HPV | 16 | 1 | 7 | B*2705 | GRINCNSN | 1092 | 200.00 | 8 |
| 56 | HPV | 16 | 1 | 7 | B*2705 | LRYRFKKH | 1093 | 300.00 | 8 |
| 57 | HPV | 16 | 1 | 7 | B*2705 | YRFKKHCT | 1094 | 1000.00 | 8 |
| 58 | HPV | 16 | 1 | 7 | B*2705 | DQFLSQVK | 1095 | 100.00 | 8 |
| 59 | HPV | 16 | 1 | 7 | B*5102 | LAVSKNKAL | 1096 | 181.50 | 9 |
| 60 | HPV | 16 | 1 | 7 | B*5102 | QAIELQLTL | 1097 | 199.65 | 9 |
| 61 | HPV | 16 | 1 | 7 | B*2705 | LQLTLETIY | 1098 | 100.00 | 9 |
| 62 | HPV | 16 | 1 | 7 | A24 | QYSNEKWTL | 1099 | 200.00 | 9 |
| 63 | HPV | 16 | 1 | 7 | Cw*0401 | QYSNEKWTL | 1099 | 200.00 | 9 |
| 64 | HPV | 16 | 1 | 7 | A*0201 | TLQDVSLEV | 1100 | 285.16 | 9 |
| 65 | HPV | 16 | 1 | 7 | B*2705 | LQDVSLEVY | 1101 | 100.00 | 9 |
| 66 | HPV | 16 | 1 | 7 | B*2705 | VQFDGDICN | 1102 | 100.00 | 9 |
| 67 | HPV | 16 | 1 | 7 | B*2705 | GQVDYYGLY | 1103 | 100.00 | 9 |
| 68 | HPV | 16 | 1 | 7 | A1 | QVDYYGLYY | 1104 | 125.00 | 9 |
| 69 | HPV | 16 | 1 | 7 | B*3801 | VHEGIRTYF | 1105 | 280.80 | 9 |
| 70 | HPV | 16 | 1 | 7 | B*2705 | IRTYFVQFK | 1106 | 2000.00 | 9 |
| 71 | HPV | 16 | 1 | 7 | B*2705 | VQFKDDAEK | 1107 | 1000.00 | 9 |
| 72 | HPV | 16 | 1 | 7 | A68.1 | EVSSPEIIR | 1108 | 900.00 | 9 |
| 73 | HPV | 16 | 1 | 7 | B*2705 | QRPRSEPDT | 1109 | 200.00 | 9 |
| 74 | HPV | 16 | 1 | 7 | B*5102 | NPCHTTKLL | 1110 | 146.41 | 9 |

TABLE 7-continued

| No | Species | Strain type | Frame | ORF | HLA | Seq | Seq ID No. | Score | Length |
|---|---|---|---|---|---|---|---|---|---|
| 75 | HPV | 16 | 1 | 7 | B*2705 | GRINCNSNT | 1111 | 200.00 | 9 |
| 76 | HPV | 16 | 1 | 7 | A68.1 | NTLKCLRYR | 1112 | 100.00 | 9 |
| 77 | HPV | 16 | 1 | 7 | B62 | TLKCLRYRF | 1113 | 120.00 | 9 |
| 78 | HPV | 16 | 1 | 7 | B*2705 | LRYRFKKHC | 1114 | 300.00 | 9 |
| 79 | HPV | 16 | 1 | 7 | B14 | YRFKKHCTL | 1115 | 100.00 | 9 |
| 80 | HPV | 16 | 1 | 7 | B*2702 | YRFKKHCTL | 1115 | 300.00 | 9 |
| 81 | HPV | 16 | 1 | 7 | B*2705 | YRFKKHCTL | 1115 | 10000.00 | 9 |
| 82 | HPV | 16 | 1 | 7 | B*2705 | SEWQRDQFL | 1116 | 150.00 | 9 |
| 83 | HPV | 16 | 1 | 7 | B60 | SEWQRDQFL | 1116 | 160.00 | 9 |
| 84 | HPV | 16 | 1 | 7 | B*2705 | QRDQFLSQV | 1117 | 600.00 | 9 |
| 85 | HPV | 16 | 1 | 7 | B*5801 | KTITVSTGF | 1118 | 180.00 | 9 |
| 86 | HPV | 16 | 1 | 7 | B*5102 | KALQAIELQL | 1119 | 165.00 | 10 |
| 87 | HPV | 16 | 1 | 7 | B*2702 | LQAIELQLTL | 1120 | 200.00 | 10 |
| 88 | HPV | 16 | 1 | 7 | B*2705 | SQYSNEKWTL | 1121 | 1000.00 | 10 |
| 89 | HPV | 16 | 1 | 7 | B*2705 | LQDVSLEVYL | 1122 | 200.00 | 10 |
| 90 | HPV | 16 | 1 | 7 | B*2705 | VQFDGDICNT | 1123 | 100.00 | 10 |
| 91 | HPV | 16 | 1 | 7 | Cw*0401 | QFDGDICNTM | 1124 | 150.00 | 10 |
| 92 | HPV | 16 | 1 | 7 | A*0201 | YICEEASVTV | 1125 | 180.37 | 10 |
| 93 | HPV | 16 | 1 | 7 | B60 | VEGQVDYYGL | 1126 | 320.00 | 10 |
| 94 | HPV | 16 | 1 | 7 | B*2705 | GQVDYYGLYY | 1127 | 100.00 | 10 |
| 95 | HPV | 16 | 1 | 7 | B62 | GQVDYYGLYY | 1127 | 116.16 | 10 |
| 96 | HPV | 16 | 1 | 7 | B*5102 | YGLYYVHEGI | 1128 | 580.80 | 10 |
| 97 | HPV | 16 | 1 | 7 | A68.1 | FVQFKDDAEK | 1129 | 180.00 | 10 |
| 98 | HPV | 16 | 1 | 7 | B*2702 | VQFKDDAEKY | 1130 | 100.00 | 10 |
| 99 | HPV | 16 | 1 | 7 | B*2705 | VQFKDDAEKY | 1130 | 500.00 | 10 |
| 100 | HPV | 16 | 1 | 7 | B*5102 | DAEKYSKNKV | 1131 | 110.00 | 10 |
| 101 | HPV | 16 | 1 | 7 | B*5103 | DAEKYSKNKV | 1131 | 121.00 | 10 |
| 102 | HPV | 16 | 1 | 7 | B*2705 | IRQHLANHPA | 1132 | 200.00 | 10 |
| 103 | HPV | 16 | 1 | 7 | B*5102 | HPAATHTKAV | 1133 | 242.00 | 10 |
| 104 | HPV | 16 | 1 | 7 | B*5102 | LGTEETQTTI | 1134 | 117.13 | 10 |
| 105 | HPV | 16 | 1 | 7 | A68.1 | ETQTTIQRPR | 1135 | 150.00 | 10 |
| 106 | HPV | 16 | 1 | 7 | A68.1 | DTGNPCHTTK | 1136 | 180.00 | 10 |
| 107 | HPV | 16 | 1 | 7 | B*2705 | HRDSVDSAPI | 1137 | 600.00 | 10 |
| 108 | HPV | 16 | 1 | 7 | B*2705 | GRINCNSNTT | 1138 | 200.00 | 10 |
| 109 | HPV | 16 | 1 | 7 | B*3901 | VHLKGDANTL | 1139 | 180.00 | 10 |
| 110 | HPV | 16 | 1 | 7 | B*5801 | NTLKCLRYRF | 1140 | 145.20 | 10 |
| 111 | HPV | 16 | 1 | 7 | B*2702 | LRYRFKKHCT | 1141 | 100.00 | 10 |
| 112 | HPV | 16 | 1 | 7 | B*2705 | LRYRFKKHCT | 1141 | 1000.00 | 10 |
| 113 | HPV | 16 | 1 | 7 | Cw*0401 | RYRFKKHCTL | 1142 | 200.00 | 10 |
| 114 | HPV | 16 | 1 | 7 | A24 | RYRFKKHCTL | 1142 | 400.00 | 10 |
| 115 | HPV | 16 | 1 | 7 | B*2702 | YRFKKHCTLY | 1143 | 1000.00 | 10 |
| 116 | HPV | 16 | 1 | 7 | B*2705 | YRFKHHCTLY | 1143 | 5000.00 | 10 |
| 117 | HPV | 16 | 1 | 7 | B*2705 | QRDQFLSQVK | 1144 | 2000.00 | 10 |
| 118 | HPV | 16 | 1 | 8 | B*2705 | WRAFCFAL | 1145 | 2000.00 | 8 |
| 119 | HPV | 16 | 1 | 8 | B*5102 | CAFVCLPI | 1146 | 1000.00 | 8 |
| 120 | HPV | 16 | 1 | 8 | B*5102 | AAFVCVYI | 1147 | 1000.00 | 8 |
| 121 | HPV | 16 | 1 | 8 | B*2705 | WRAFCFALC | 1148 | 200.00 | 9 |
| 122 | HPV | 16 | 1 | 8 | Cw*0401 | AFCFALCAF | 1149 | 220.00 | 9 |
| 123 | HPV | 16 | 1 | 8 | Cw*0301 | FALCAFVCL | 1150 | 200.00 | 9 |
| 124 | HPV | 16 | 1 | 8 | B*5102 | FALCAFVCL | 1150 | 300.00 | 9 |
| 125 | HPV | 16 | 1 | 8 | B*5103 | SAAFVCVYI | 1151 | 121.00 | 9 |
| 126 | HPV | 16 | 1 | 8 | B*5102 | SAAFVCVYI | 1151 | 242.00 | 9 |
| 127 | HPV | 16 | 1 | 8 | A24 | VYIHIINNI | 1152 | 126.00 | 9 |
| 128 | HPV | 16 | 1 | 8 | Cw*0401 | HYWRAFCFAL | 1153 | 200.00 | 10 |
| 129 | HPV | 16 | 1 | 8 | A24 | HYWRAFCFAL | 1153 | 200.00 | 10 |
| 130 | HPV | 16 | 1 | 8 | B*2705 | WRAFCFALCA | 1154 | 200.00 | 10 |
| 131 | HPV | 16 | 1 | 8 | Cw*0401 | CFALCAFVCL | 1155 | 220.00 | 10 |
| 132 | HPV | 16 | 1 | 8 | B*5102 | LPINTSAAFV | 1156 | 660.00 | 10 |
| 133 | HPV | 16 | 1 | 8 | B*5102 | AAFVCVYIHI | 1157 | 1100.00 | 10 |
| 134 | HPV | 16 | 1 | 8 | B*5103 | AAFVCVYIHI | 1157 | 145.20 | 10 |
| 135 | HPV | 16 | 1 | 9 | B*2705 | TQTFCKTHK | 1158 | 200.00 | 9 |
| 136 | HPV | 16 | 1 | 10 | A*0201 | CLLSQYLRL | 1159 | 118.56 | 9 |
| 137 | HPV | 16 | 1 | 10 | Cw*0301 | CLLSQYLRL | 1159 | 100.00 | 9 |
| 138 | HPV | 16 | 1 | 10 | Cw*0301 | TCLLSQYLRL | 1160 | 100.00 | 10 |
| 139 | HPV | 16 | 1 | 11 | B*5102 | TPISLVFL | 1161 | 300.00 | 8 |
| 140 | HPV | 16 | 1 | 11 | B*5102 | TPHFIIQI | 1162 | 484.00 | 8 |
| 141 | HPV | 16 | 1 | 11 | B*2705 | IQIHSGWF | 1163 | 100.00 | 8 |
| 142 | HPV | 16 | 1 | 11 | A*0201 | FLTPHFIIQI | 1164 | 419.44 | 10 |
| 143 | HPV | 16 | 1 | 12 | B*5102 | LALVLWTL | 1165 | 150.00 | 8 |
| 144 | HPV | 16 | 1 | 12 | B*2705 | YRLTKVKF | 1166 | 300.00 | 8 |
| 145 | HPV | 16 | 1 | 12 | B*3901 | FHWIFVHL | 1167 | 270.00 | 8 |
| 146 | HPV | 16 | 1 | 12 | B*5102 | FANIQIIL | 1168 | 121.00 | 8 |
| 147 | HPV | 16 | 1 | 12 | B*5102 | MATAYFFI | 1169 | 200.00 | 8 |
| 148 | HPV | 16 | 1 | 12 | B*2705 | YQTIYTLK | 1170 | 200.00 | 8 |

TABLE 7-continued

| No | Species | Strain type | Frame | ORF | HLA | Seq | Seq ID No. | Score | Length |
|---|---|---|---|---|---|---|---|---|---|
| 149 | HPV | 16 | 1 | 12 | B*5102 | KALGLLQI | 1171 | 726.00 | 8 |
| 150 | HPV | 16 | 1 | 12 | B*5102 | LALVLWTLL | 1172 | 150.00 | 9 |
| 151 | HPV | 16 | 1 | 12 | A3 | TLLHYRLTK | 1173 | 180.00 | 9 |
| 152 | HPV | 16 | 1 | 12 | A*0201 | LLHYRLTKV | 1174 | 271.95 | 9 |
| 153 | HPV | 16 | 1 | 12 | A24 | HYRLTKVKF | 1175 | 110.00 | 9 |
| 154 | HPV | 16 | 1 | 12 | Cw*0401 | HYRLTKVKF | 1175 | 132.00 | 9 |
| 155 | HPV | 16 | 1 | 12 | Cw*0401 | KFHWIFVHL | 1176 | 330.00 | 9 |
| 156 | HPV | 16 | 1 | 12 | Cw*0401 | LFANIQIIL | 1177 | 200.00 | 9 |
| 157 | HPV | 16 | 1 | 12 | B*2705 | CQNHMATAY | 1178 | 100.00 | 9 |
| 158 | HPV | 16 | 1 | 12 | A*0201 | FIYEGNKCL | 1179 | 177.27 | 9 |
| 159 | HPV | 16 | 1 | 12 | A*0205 | FIYEGNKCL | 1179 | 189.00 | 9 |
| 160 | HPV | 16 | 1 | 12 | A24 | IYEGNKCLL | 1180 | 300.00 | 9 |
| 161 | HPV | 16 | 1 | 12 | Cw*0401 | IYEGNKCLL | 1180 | 200.00 | 9 |
| 162 | HPV | 16 | 1 | 12 | A24 | IYLIGLVLL | 1181 | 300.00 | 9 |
| 163 | HPV | 16 | 1 | 12 | Cw*0401 | IYLIGLVLL | 1181 | 400.00 | 9 |
| 164 | HPV | 16 | 1 | 12 | A*0201 | YLIGLVLLV | 1182 | 735.86 | 9 |
| 165 | HPV | 16 | 1 | 12 | A*0201 | VLLVKMYQT | 1183 | 107.81 | 9 |
| 166 | HPV | 16 | 1 | 12 | A*0201 | KMYQTIYTL | 1184 | 397.44 | 9 |
| 167 | HPV | 16 | 1 | 12 | A*0205 | KMYQTIYTL | 1184 | 126.00 | 9 |
| 168 | HPV | 16 | 1 | 12 | B*2705 | KMYQTIYTL | 1184 | 750.00 | 9 |
| 169 | HPV | 16 | 1 | 12 | A24 | IYTLKALGL | 1185 | 200.00 | 9 |
| 170 | HPV | 16 | 1 | 12 | Cw*0401 | IYTLKALGL | 1185 | 200.00 | 9 |
| 171 | HPV | 16 | 1 | 12 | A68.1 | LVLWTLLHYR | 1186 | 400.00 | 10 |
| 172 | HPV | 16 | 1 | 12 | A*0201 | VLWTLLHYRL | 1187 | 301.42 | 10 |
| 173 | HPV | 16 | 1 | 12 | B*2705 | VLWTLLHYRL | 1187 | 150.00 | 10 |
| 174 | HPV | 16 | 1 | 12 | A*0201 | TLLHYRLTKV | 1188 | 591.89 | 10 |
| 175 | HPV | 16 | 1 | 12 | B*2702 | YRLTKVKFHW | 1189 | 100.00 | 10 |
| 176 | HPV | 16 | 1 | 12 | B*2705 | YRLTKVKFHW | 1189 | 200.00 | 10 |
| 177 | HPV | 16 | 1 | 12 | A*0201 | RLTKVKFHWI | 1190 | 109.02 | 10 |
| 178 | HPV | 16 | 1 | 12 | Cw*0401 | KFHWIFVHLF | 1191 | 300.00 | 10 |
| 179 | HPV | 16 | 1 | 12 | B*2705 | HLFANIQIIL | 1192 | 150.00 | 10 |
| 180 | HPV | 16 | 1 | 12 | B*2705 | CQNHMATAYF | 1193 | 100.00 | 10 |
| 181 | HPV | 16 | 1 | 12 | A3 | HMATAYFFIY | 1194 | 108.00 | 10 |
| 182 | HPV | 16 | 1 | 12 | Cw*0401 | FFIYEGNKCL | 1195 | 200.00 | 10 |
| 183 | HPV | 16 | 1 | 12 | A*0201 | FIYEGNKCLL | 1196 | 177.27 | 10 |
| 184 | HPV | 16 | 1 | 12 | A*0205 | FIYEGNKCLL | 1196 | 189.00 | 10 |
| 185 | HPV | 16 | 1 | 12 | A*0201 | CLLDIYLIGL | 1197 | 745.36 | 10 |
| 186 | HPV | 16 | 1 | 12 | A*0205 | CLLDIYLIGL | 1197 | 151.20 | 10 |
| 187 | HPV | 16 | 1 | 12 | A3 | YLIGLVLLVK | 1198 | 202.50 | 10 |
| 188 | HPV | 16 | 1 | 12 | A3 | KMYQTIYTLK | 1199 | 450.00 | 10 |
| 189 | HPV | 16 | 1 | 12 | B*2705 | KMYQTIYTLK | 1199 | 750.00 | 10 |
| 190 | HPV | 16 | 1 | 12 | Cw*0401 | IYTLKALGLL | 1200 | 440.00 | 10 |
| 191 | HPV | 16 | 1 | 12 | A24 | IYTLKALGLL | 1200 | 200.00 | 10 |
| 192 | HPV | 16 | 1 | 13 | B*2705 | HRATIMAF | 1201 | 1000.00 | 8 |
| 193 | HPV | 16 | 1 | 13 | B*5102 | RATIMAFV | 1202 | 100.00 | 8 |
| 194 | HPV | 16 | 1 | 13 | B*2705 | TNYLLLLL | 1203 | 100.00 | 8 |
| 195 | HPV | 16 | 1 | 13 | B*2705 | VQICHYVL | 1204 | 200.00 | 8 |
| 196 | HPV | 16 | 1 | 13 | B*3901 | CHYVLPYL | 1205 | 180.00 | 8 |
| 197 | HPV | 16 | 1 | 13 | B*5102 | LPYLLQKL | 1206 | 665.50 | 8 |
| 198 | HPV | 16 | 1 | 13 | B*3901 | LHIKILTL | 1207 | 270.00 | 8 |
| 199 | HPV | 16 | 1 | 13 | B*2705 | GRNMIYSL | 1208 | 2000.00 | 8 |
| 200 | HPV | 16 | 1 | 13 | B*2705 | SLFFNCAK | 1209 | 150.00 | 8 |
| 201 | HPV | 16 | 1 | 13 | B*5102 | MPKYSINLI | 1210 | 220.00 | 9 |
| 202 | HPV | 16 | 1 | 13 | B*2705 | HRATIMAFV | 1211 | 600.00 | 9 |
| 203 | HPV | 16 | 1 | 13 | Cw*0401 | AFVGVTNYL | 1212 | 200.00 | 9 |
| 204 | HPV | 16 | 1 | 13 | Cw*0301 | VGVTNYLLL | 1213 | 120.00 | 9 |
| 205 | HPV | 16 | 1 | 13 | A24 | NYLLLLLIL | 1214 | 360.00 | 9 |
| 206 | HPV | 16 | 1 | 13 | Cw*0401 | NYLLLLLIL | 1214 | 400.00 | 9 |
| 207 | HPV | 16 | 1 | 13 | A*0201 | LLLLILHAV | 1215 | 1006.21 | 9 |
| 208 | HPV | 16 | 1 | 13 | B*5103 | HAVQICHYV | 1216 | 110.00 | 9 |
| 209 | HPV | 16 | 1 | 13 | B*5102 | HAVQICHYV | 1216 | 363.00 | 9 |
| 210 | HPV | 16 | 1 | 13 | B*3901 | CHYVLPYLL | 1217 | 180.00 | 9 |
| 211 | HPV | 16 | 1 | 13 | A68.1 | YVLPYLLQK | 1218 | 360.00 | 9 |
| 212 | HPV | 16 | 1 | 13 | A*0201 | KLHIKILTL | 1219 | 171.97 | 9 |
| 213 | HPV | 16 | 1 | 13 | B*2705 | LRSTYDMGR | 1220 | 1000.00 | 9 |
| 214 | HPV | 16 | 1 | 13 | B*2702 | GRNMIYSLF | 1221 | 200.00 | 9 |
| 215 | HPV | 16 | 1 | 13 | B*2705 | GRNMIYSLF | 1221 | 1000.00 | 9 |
| 216 | HPV | 16 | 1 | 13 | B*5102 | IGYNEHRATI | 1222 | 484.00 | 10 |
| 217 | HPV | 16 | 1 | 13 | B*5103 | IGYNEHRATI | 1222 | 132.00 | 10 |
| 218 | HPV | 16 | 1 | 13 | Cw*0401 | GYNEHRATIM | 1223 | 132.00 | 10 |
| 219 | HPV | 16 | 1 | 13 | B*5102 | RATIMAFVGV | 1224 | 100.00 | 10 |
| 220 | HPV | 16 | 1 | 13 | B*5103 | RATIMAFVGV | 1224 | 121.00 | 10 |
| 221 | HPV | 16 | 1 | 13 | B*5102 | MAFVGVTNYL | 1225 | 332.75 | 10 |
| 222 | HPV | 16 | 1 | 13 | Cw*0401 | AFVGVTNYLL | 1226 | 240.00 | 10 |

TABLE 7-continued

| No | Species | Strain type | Frame | ORF | HLA | Seq | Seq ID No. | Score | Length |
|---|---|---|---|---|---|---|---|---|---|
| 223 | HPV | 16 | 1 | 13 | B*2705 | TNYLLLLLIL | 1227 | 100.00 | 10 |
| 224 | HPV | 16 | 1 | 13 | A*0201 | YLLLLLILHA | 1228 | 194.48 | 10 |
| 225 | HPV | 16 | 1 | 13 | A*0201 | LLLLLILHAV | 1229 | 1006.21 | 10 |
| 226 | HPV | 16 | 1 | 13 | B*5102 | HAVQICHYVL | 1230 | 165.00 | 10 |
| 227 | HPV | 16 | 1 | 13 | B*2705 | VQICHYVLPY | 1231 | 100.00 | 10 |
| 228 | HPV | 16 | 1 | 13 | A*0205 | YVLPYLLQKL | 1232 | 252.00 | 10 |
| 229 | HPV | 16 | 1 | 13 | Cw*0301 | YVLPYLLQKL | 1232 | 120.00 | 10 |
| 230 | HPV | 16 | 1 | 13 | B*5102 | LPYLLQKLHI | 1233 | 2420.00 | 10 |
| 231 | HPV | 16 | 1 | 13 | B*5103 | LPYLLQKLHI | 1233 | 159.72 | 10 |
| 232 | HPV | 16 | 1 | 13 | A*0201 | YLLQKLHIKI | 1234 | 177.57 | 10 |
| 233 | HPV | 16 | 1 | 13 | B*2705 | LRSTYDMGRN | 1235 | 200.00 | 10 |
| 234 | HPV | 16 | 1 | 13 | B*2702 | GRNMIYSLFF | 1236 | 200.00 | 10 |
| 235 | HPV | 16 | 1 | 13 | B*2705 | GRNMIYSLFF | 1236 | 1000.00 | 10 |
| 236 | HPV | 16 | 1 | 14 | B*2705 | CMYVELVL | 1237 | 250.00 | 8 |
| 237 | HPV | 16 | 1 | 14 | Cw*0301 | CKYCMYVEL | 1238 | 100.00 | 9 |
| 238 | HPV | 16 | 1 | 14 | B*2705 | CMYVELVLF | 1239 | 125.00 | 9 |
| 239 | HPV | 16 | 1 | 14 | A*0201 | VLFVVYMFV | 1240 | 3609.23 | 9 |
| 240 | HPV | 16 | 1 | 14 | Cw*0401 | VYMFVCACM | 1241 | 120.00 | 9 |
| 241 | HPV | 16 | 1 | 14 | Cw*0401 | MFVCACMCL | 1242 | 220.00 | 9 |
| 242 | HPV | 16 | 1 | 14 | Cw*0401 | KYCMYVELVL | 1243 | 200.00 | 10 |
| 243 | HPV | 16 | 1 | 14 | A24 | KYCMYVELVL | 1243 | 560.00 | 10 |
| 244 | HPV | 16 | 1 | 14 | A*0201 | CMYVELVLFV | 1244 | 2033.39 | 10 |
| 245 | HPV | 16 | 1 | 14 | A*0201 | LVLFVVYMFV | 1245 | 315.81 | 10 |
| 246 | HPV | 16 | 1 | 14 | A*0201 | VLFVVYMFVC | 1246 | 170.91 | 10 |
| 247 | HPV | 16 | 1 | 14 | A*0201 | YMFVCACMCL | 1247 | 262.59 | 10 |
| 248 | HPV | 16 | 1 | 14 | B*2705 | YMFVCACMCL | 1247 | 250.00 | 10 |
| 249 | HPV | 16 | 1 | 15 | A*0201 | FLFYIYYIL | 1248 | 223.61 | 9 |
| 250 | HPV | 16 | 1 | 15 | A*0205 | FLFYIYYIL | 1248 | 126.00 | 9 |
| 251 | HPV | 16 | 1 | 15 | B*2705 | FLFYIYYIL | 1248 | 150.00 | 9 |
| 252 | HPV | 16 | 1 | 15 | Cw*0301 | LFLFYIYYIL | 1249 | 100.00 | 10 |
| 253 | HPV | 16 | 1 | 15 | Cw*0401 | LFLFYIYYIL | 1249 | 200.00 | 10 |
| 254 | HPV | 16 | 1 | 16 | B*2705 | CQPFHCFL | 1250 | 200.00 | 8 |
| 255 | HPV | 16 | 1 | 17 | A*0201 | LLGTYFWLV | 1251 | 1684.90 | 9 |
| 256 | HPV | 16 | 1 | 17 | Cw*0401 | YFWLVLTNL | 1252 | 400.00 | 9 |
| 257 | HPV | 16 | 1 | 17 | A*0201 | VLTNLIAYL | 1253 | 459.40 | 9 |
| 258 | HPV | 16 | 1 | 17 | Cw*0401 | TYFWLVLTNL | 1254 | 400.00 | 10 |
| 259 | HPV | 16 | 1 | 17 | A24 | TYFWLVLTNL | 1254 | 280.00 | 10 |
| 260 | HPV | 16 | 1 | 17 | A*0201 | LVLTNLIAYL | 1255 | 148.73 | 10 |
| 261 | HPV | 16 | 1 | 17 | A*0205 | LVLTNLIAYL | 1255 | 142.80 | 10 |
| 262 | HPV | 16 | 1 | 1 | B*2705 | HRAANNYT | 1256 | 200.00 | 8 |
| 263 | HPV | 16 | 1 | 3 | A*0201 | VLLQIIKNT | 1257 | 107.81 | 9 |
| 264 | HPV | 16 | 1 | 4 | B*3901 | MHGDTPTL | 1258 | 180.00 | 8 |
| 265 | HPV | 16 | 1 | 4 | B*3901 | LHEYMLDL | 1259 | 405.00 | 8 |
| 266 | HPV | 16 | 1 | 4 | B*2705 | LQPETTDL | 1260 | 200.00 | 8 |
| 267 | HPV | 16 | 1 | 4 | B*2705 | LRLCVQST | 1261 | 200.00 | 8 |
| 268 | HPV | 16 | 1 | 4 | B*3901 | THVDIRTL | 1262 | 180.00 | 8 |
| 269 | HPV | 16 | 1 | 4 | B*2705 | IRTLEDLL | 1263 | 2000.00 | 8 |
| 270 | HPV | 16 | 1 | 4 | B*5102 | TPTLHEYML | 1264 | 110.00 | 9 |
| 271 | HPV | 16 | 1 | 4 | A*0201 | TLHEYMLDL | 1265 | 201.45 | 9 |
| 272 | HPV | 16 | 1 | 4 | A*0201 | YMLDLQPET | 1266 | 375.57 | 9 |
| 273 | HPV | 16 | 1 | 4 | B*2705 | LQPETTDLY | 1267 | 100.00 | 9 |
| 274 | HPV | 16 | 1 | 4 | Cw*0301 | TDLYCYEQL | 1268 | 100.00 | 9 |
| 275 | HPV | 16 | 1 | 4 | A1 | QAEPDRAHY | 1269 | 900.00 | 9 |
| 276 | HPV | 16 | 1 | 4 | B*5102 | EPDRAHYNI | 1270 | 220.00 | 9 |
| 277 | HPV | 16 | 1 | 4 | B*2705 | LRLCVQSTH | 1271 | 200.00 | 9 |
| 278 | HPV | 16 | 1 | 4 | B*2705 | VQSTHVDIR | 1272 | 100.00 | 9 |
| 279 | HPV | 16 | 1 | 4 | B*2705 | IRTLEDLLM | 1273 | 600.00 | 9 |
| 280 | HPV | 16 | 1 | 4 | B60 | LEDLLMGTL | 1274 | 176.00 | 9 |
| 281 | HPV | 16 | 1 | 4 | A68.1 | IVCPICSQK | 1045 | 180.00 | 9 |
| 282 | HPV | 16 | 1 | 4 | A*0201 | YMLDLQPETT | 1275 | 184.03 | 10 |
| 283 | HPV | 16 | 1 | 4 | B40 | DEIDGPAGQA | 1276 | 120.00 | 10 |
| 284 | HPV | 16 | 1 | 4 | B*2705 | GQAEPDRAHY | 1277 | 100.00 | 10 |
| 285 | HPV | 16 | 1 | 4 | B*5102 | EPDRAHYNIV | 1278 | 110.00 | 10 |
| 286 | HPV | 16 | 1 | 4 | B*5201 | EPDRAHYNIV | 1278 | 100.00 | 10 |
| 287 | HPV | 16 | 1 | 4 | B*2705 | DRAHYNIVTF | 1279 | 100.00 | 10 |
| 288 | HPV | 16 | 1 | 4 | Cw*0401 | TFCCKCDSTL | 1280 | 200.00 | 10 |
| 289 | HPV | 16 | 1 | 4 | B*2705 | LRLCVQSTHV | 1281 | 600.00 | 10 |
| 290 | HPV | 16 | 1 | 4 | A68.1 | CVQSTHVDIR | 1282 | 200.00 | 10 |
| 291 | HPV | 16 | 1 | 4 | B*3701 | VDIRTLEDLL | 1283 | 200.00 | 10 |
| 292 | HPV | 16 | 1 | 5 | B*2705 | AQEAKQHR | 1284 | 100.00 | 8 |
| 293 | HPV | 16 | 1 | 5 | B*2705 | HRDAVQVL | 1285 | 2000.00 | 8 |
| 294 | HPV | 16 | 1 | 5 | B*2705 | KRKYLVVH | 1286 | 600.00 | 8 |
| 295 | HPV | 16 | 1 | 5 | B*5102 | NGWFYVEAV | 1287 | 220.00 | 9 |
| 296 | HPV | 16 | 1 | 5 | B*5201 | GWFYVEAVV | 1288 | 100.00 | 9 |

TABLE 7-continued

| No | Species | Strain type | Frame | ORF | HLA | Seq | Seq ID No. | Score | Length |
|---|---|---|---|---|---|---|---|---|---|
| 297 | HPV | 16 | 1 | 5 | A68.1 | YVEAVVEKK | 1289 | 120.00 | 9 |
| 298 | HPV | 16 | 1 | 5 | B60 | AETETAHAL | 1290 | 160.00 | 9 |
| 299 | HPV | 16 | 1 | 5 | A3 | ALFTAQEAK | 1291 | 100.00 | 9 |
| 300 | HPV | 16 | 1 | 5 | B*2705 | ALFTAQEAK | 1291 | 150.00 | 9 |
| 301 | HPV | 16 | 1 | 5 | B*5103 | EAKQHRDAV | 1292 | 110.00 | 9 |
| 302 | HPV | 16 | 1 | 5 | B*2705 | KQHRDAVQV | 1293 | 180.00 | 9 |
| 303 | HPV | 16 | 1 | 5 | B*2705 | HRDAVQVLK | 1294 | 2000.00 | 9 |
| 304 | HPV | 16 | 1 | 5 | B*2702 | KRKYLVVHL | 1295 | 180.00 | 9 |
| 305 | HPV | 16 | 1 | 5 | B*2705 | KRKYLVVHL | 1295 | 6000.00 | 9 |
| 306 | HPV | 16 | 1 | 5 | A24 | KYLVVHLVI | 1296 | 210.00 | 9 |
| 307 | HPV | 16 | 1 | 5 | B*5102 | NGWFYVEAVV | 1297 | 220.00 | 10 |
| 308 | HPV | 16 | 1 | 5 | B*5201 | NGWFYVEAVV | 1297 | 500.00 | 10 |
| 309 | HPV | 16 | 1 | 5 | B*5201 | TGEDLVDFIV | 1298 | 100.00 | 10 |
| 310 | HPV | 16 | 1 | 5 | Cw*0401 | DFIVNDNDYL | 1299 | 200.00 | 10 |
| 311 | HPV | 16 | 1 | 5 | A68.1 | FTAQEAKQHR | 1300 | 150.00 | 10 |
| 312 | HPV | 16 | 1 | 5 | B*2705 | KQHRDAVQVL | 1301 | 600.00 | 10 |
| 313 | HPV | 16 | 1 | 5 | B*2705 | HRDAVQVLKR | 1302 | 1000.00 | 10 |
| 314 | HPV | 16 | 1 | 5 | B*2705 | KRKYLVVHLV | 1303 | 1800.00 | 10 |
| 315 | HPV | 16 | 1 | 5 | Cw*0401 | KYLVVHLVIL | 1304 | 440.00 | 10 |
| 316 | HPV | 16 | 1 | 5 | A24 | KYLVVHLVIL | 1304 | 600.00 | 10 |
| 317 | HPV | 16 | 1 | 5 | A*0201 | YLVVHLVILV | 1305 | 735.86 | 10 |
| 318 | HPV | 16 | 1 | 6 | B*5102 | MAILKWKL | 1047 | 181.50 | 8 |
| 319 | HPV | 16 | 1 | 6 | B62 | ILKWKLSRCY | 1052 | 312.00 | 10 |
| 320 | HPV | 16 | 1 | 7 | B*2705 | MRLKHHVV | 1306 | 600.00 | 8 |
| 321 | HPV | 16 | 1 | 7 | B*2705 | TLYAKHHL | 1053 | 150.00 | 8 |
| 322 | HPV | 16 | 1 | 7 | B*5102 | YAKHHLQI | 1054 | 242.00 | 8 |
| 323 | HPV | 16 | 1 | 7 | B*2705 | MRLKHHVVS | 1307 | 200.00 | 9 |
| 324 | HPV | 16 | 1 | 7 | B*5102 | VGVVAVSTV | 1055 | 132.00 | 9 |
| 325 | HPV | 16 | 1 | 7 | B*5103 | VAVSTVVEV | 1056 | 121.00 | 9 |
| 326 | HPV | 16 | 1 | 7 | B*5102 | VAVSTVVEV | 1056 | 330.00 | 9 |
| 327 | HPV | 16 | 1 | 7 | A68.1 | STVVEVGER | 1057 | 100.00 | 9 |
| 328 | HPV | 16 | 1 | 7 | A68.1 | EVGERVLVK | 1058 | 720.00 | 9 |
| 329 | HPV | 16 | 1 | 7 | B14 | ERVLVKDTL | 1059 | 180.00 | 9 |
| 330 | HPV | 16 | 1 | 7 | B*2705 | ERVLVKDTL | 1059 | 200.00 | 9 |
| 331 | HPV | 16 | 1 | 7 | A68.1 | LVKDTLYAK | 1060 | 120.00 | 9 |
| 332 | HPV | 16 | 1 | 7 | B14 | MRLKHHVVSI | 1308 | 120.00 | 10 |
| 333 | HPV | 16 | 1 | 7 | B*2705 | MRLKHHVVSI | 1308 | 600.00 | 10 |
| 334 | HPV | 16 | 1 | 7 | B*5102 | VGVVAVSTVV | 1061 | 132.00 | 10 |
| 335 | HPV | 16 | 1 | 7 | B*5201 | VGVVAVSTVV | 1061 | 198.00 | 10 |
| 336 | HPV | 16 | 1 | 7 | B60 | GERVLVKDTL | 1062 | 176.00 | 10 |
| 337 | HPV | 16 | 1 | 7 | B*2705 | ERVLVKDTLY | 1063 | 100.00 | 10 |
| 338 | HPV | 16 | 1 | 7 | A3 | VLVKDTLYAK | 1064 | 135.00 | 10 |
| 339 | HPV | 16 | 1 | 7 | Cw*0401 | LYAKHHLQIF | 1065 | 220.00 | 10 |
| 340 | HPV | 16 | 1 | 7 | A24 | LYAKHHLQIF | 1065 | 120.00 | 10 |
| 341 | HPV | 16 | 1 | 8 | B*2705 | RQNGYKDK | 1309 | 600.00 | 8 |
| 342 | HPV | 16 | 1 | 8 | B*2705 | KQYYNIVL | 1310 | 3000.00 | 8 |
| 343 | HPV | 16 | 1 | 8 | B*2705 | HRWYNGPT | 1311 | 1000.00 | 8 |
| 344 | HPV | 16 | 1 | 8 | B*2705 | TRQNGYKDK | 1312 | 600.00 | 9 |
| 345 | HPV | 16 | 1 | 8 | B*2705 | KQYYNIVLM | 1313 | 900.00 | 9 |
| 346 | HPV | 16 | 1 | 8 | B*2702 | HRWYNGPTI | 1314 | 300.00 | 9 |
| 347 | HPV | 16 | 1 | 8 | B*2705 | HRWYNGPTI | 1314 | 3000.00 | 9 |
| 348 | HPV | 16 | 1 | 8 | B*2705 | KQYYNIVLMI | 1315 | 900.00 | 10 |
| 349 | HPV | 16 | 1 | 8 | B*5201 | KQYYNIVLMI | 1315 | 300.00 | 10 |
| 350 | HPV | 16 | 1 | 8 | B*5201 | QYYNIVLMIV | 1316 | 110.00 | 10 |
| 351 | HPV | 16 | 1 | 8 | B*2702 | HRWYNGPTIM | 1317 | 100.00 | 10 |
| 352 | HPV | 16 | 1 | 8 | B*2705 | HRWYNGPTIM | 1317 | 3000.00 | 10 |
| 353 | HPV | 16 | 1 | 10 | B60 | MEVIGSKLL | 1318 | 320.00 | 9 |
| 354 | HPV | 16 | 1 | 11 | B*2705 | VQLTQVNHY | 1319 | 100.00 | 9 |
| 355 | HPV | 16 | 1 | 11 | A*0201 | QLTQVNHYL | 1320 | 117.49 | 9 |
| 356 | HPV | 16 | 1 | 11 | B*2705 | VQLTQVNHYL | 1321 | 200.00 | 10 |
| 357 | HPV | 16 | 1 | 13 | B*2705 | IRTGNPFS | 1067 | 200.00 | 8 |
| 358 | HPV | 16 | 1 | 13 | B*2705 | VQILGGLIY | 1068 | 100.00 | 9 |
| 359 | HPV | 16 | 1 | 13 | B62 | VQILGGLIY | 1068 | 192.00 | 9 |
| 360 | HPV | 16 | 1 | 13 | A*0201 | LIYIIDWWC | 1069 | 153.29 | 9 |
| 361 | HPV | 16 | 1 | 13 | A24 | IYIIDWWCL | 1070 | 300.00 | 9 |
| 362 | HPV | 16 | 1 | 13 | Cw*0401 | IYIIDWWCL | 1070 | 200.00 | 9 |
| 363 | HPV | 16 | 1 | 13 | B*3701 | IDWWCLHFL | 1071 | 200.00 | 9 |
| 364 | HPV | 16 | 1 | 13 | B*3901 | LHFLMSFHL | 1072 | 180.00 | 9 |
| 365 | HPV | 16 | 1 | 13 | A3 | FLMSFHLTK | 1073 | 180.00 | 9 |
| 366 | HPV | 16 | 1 | 13 | B*2705 | IQCMSLMIR | 1074 | 100.00 | 9 |
| 367 | HPV | 16 | 1 | 13 | A*0201 | GLIYIIDWWC | 1075 | 204.93 | 10 |
| 368 | HPV | 16 | 1 | 13 | A*0201 | LIYIIDWWCL | 1076 | 203.73 | 10 |
| 369 | HPV | 16 | 1 | 13 | A*0201 | CLHFLMSFHL | 1077 | 123.90 | 10 |
| 370 | HPV | 16 | 1 | 13 | A*0201 | FLMSFHLTKT | 1078 | 291.72 | 10 |

TABLE 7-continued

| No | Species | Strain type | Frame | ORF | HLA | Seq | Seq ID No. | Score | Length |
|---|---|---|---|---|---|---|---|---|---|
| 371 | HPV | 16 | 1 | 13 | A68.1 | RTGNPFSQGR | 1079 | 100.00 | 10 |
| 372 | HPV | 16 | 1 | 14 | B*2705 | LRDHIDYW | 1322 | 200.00 | 8 |
| 373 | HPV | 16 | 1 | 14 | B*2705 | MRLECAIY | 1323 | 1000.00 | 8 |
| 374 | HPV | 16 | 1 | 14 | B*5102 | KALQAIEL | 1080 | 199.65 | 8 |
| 375 | HPV | 16 | 1 | 14 | B*2705 | LQAIELQL | 1081 | 200.00 | 8 |
| 376 | HPV | 16 | 1 | 14 | B*2705 | VQFDGDIC | 1082 | 100.00 | 8 |
| 377 | HPV | 16 | 1 | 14 | B*2705 | GQVDYYGL | 1083 | 200.00 | 8 |
| 378 | HPV | 16 | 1 | 14 | B*5102 | EGIRTYFV | 1084 | 145.20 | 8 |
| 379 | HPV | 16 | 1 | 14 | B*2705 | IRTYFVQF | 1085 | 1000.00 | 8 |
| 380 | HPV | 16 | 1 | 14 | B*2705 | RTYFVQFK | 1086 | 150.00 | 8 |
| 381 | HPV | 16 | 1 | 14 | B*2705 | IRQHLANH | 1087 | 200.00 | 8 |
| 382 | HPV | 16 | 1 | 14 | B*5102 | AATHTKAV | 1088 | 121.00 | 8 |
| 383 | HPV | 16 | 1 | 14 | B*3901 | THTKAVAL | 1089 | 135.00 | 8 |
| 384 | HPV | 16 | 1 | 14 | B*5102 | NPCHTTKL | 1090 | 146.41 | 8 |
| 385 | HPV | 16 | 1 | 14 | B*2705 | HRDSVDSA | 1091 | 200.00 | 8 |
| 386 | HPV | 16 | 1 | 14 | B*2705 | GRINCNSN | 1092 | 200.00 | 8 |
| 387 | HPV | 16 | 1 | 14 | B*2705 | LRYRFKKH | 1093 | 300.00 | 8 |
| 388 | HPV | 16 | 1 | 14 | B*2705 | YRFKKHCT | 1094 | 1000.00 | 8 |
| 389 | HPV | 16 | 1 | 14 | B*2705 | DQFLSQVK | 1095 | 100.00 | 8 |
| 390 | HPV | 16 | 1 | 14 | B*2705 | QRLNVCQDK | 1324 | 2000.00 | 9 |
| 391 | HPV | 16 | 1 | 14 | B*2705 | CQDKILTHY | 1325 | 100.00 | 9 |
| 392 | HPV | 16 | 1 | 14 | A24 | HYENDSTDL | 1326 | 300.00 | 9 |
| 393 | HPV | 16 | 1 | 14 | Cw*0401 | HYENDSTDL | 1326 | 200.00 | 9 |
| 394 | HPV | 16 | 1 | 14 | B*2705 | LRDHIDYWK | 1327 | 2000.00 | 9 |
| 395 | HPV | 16 | 1 | 14 | B*3901 | DHIDYWKHM | 1328 | 120.00 | 9 |
| 396 | HPV | 16 | 1 | 14 | B*2702 | MRLECAIYY | 1329 | 200.00 | 9 |
| 397 | HPV | 16 | 1 | 14 | B*2705 | MRLECAIYY | 1329 | 1000.00 | 9 |
| 398 | HPV | 16 | 1 | 14 | A24 | YYKAREMGF | 1330 | 100.00 | 9 |
| 399 | HPV | 16 | 1 | 14 | Cw*0401 | YYKAREMGF | 1330 | 110.00 | 9 |
| 400 | HPV | 16 | 1 | 14 | B*2705 | AREMGFKHI | 1331 | 180.00 | 9 |
| 401 | HPV | 16 | 1 | 14 | A68.1 | VVPTLAVSK | 1332 | 120.00 | 9 |
| 402 | HPV | 16 | 1 | 14 | B*5102 | LAVSKNKAL | 1096 | 181.50 | 9 |
| 403 | HPV | 16 | 1 | 14 | B*5102 | QAIELQLTL | 1097 | 199.65 | 9 |
| 404 | HPV | 16 | 1 | 14 | B*2705 | LQLTLETIY | 1098 | 100.00 | 9 |
| 405 | HPV | 16 | 1 | 14 | A24 | QYSNEKWTL | 1099 | 200.00 | 9 |
| 406 | HPV | 16 | 1 | 14 | Cw*0401 | QYSNEKWTL | 1099 | 200.00 | 9 |
| 407 | HPV | 16 | 1 | 14 | A*0201 | TLQDVSLEV | 1100 | 285.16 | 9 |
| 408 | HPV | 16 | 1 | 14 | B*2705 | LQDVSLEVY | 1101 | 100.00 | 9 |
| 409 | HPV | 16 | 1 | 14 | B*2705 | VQFDGDICN | 1102 | 100.00 | 9 |
| 410 | HPV | 16 | 1 | 14 | B*2705 | GQVDYYGLY | 1103 | 100.00 | 9 |
| 411 | HPV | 16 | 1 | 14 | A1 | QVDYYGLYY | 1104 | 125.00 | 9 |
| 412 | HPV | 16 | 1 | 14 | B*3801 | VHEGIRTYF | 1105 | 280.80 | 9 |
| 413 | HPV | 16 | 1 | 14 | B*2705 | IRTYFVQFK | 1106 | 2000.00 | 9 |
| 414 | HPV | 16 | 1 | 14 | B*2705 | VQFKDDAEK | 1107 | 1000.00 | 9 |
| 415 | HPV | 16 | 1 | 14 | A68.1 | EVSSPEIIR | 1108 | 900.00 | 9 |
| 416 | HPV | 16 | 1 | 14 | B*2705 | QRPRSEPDT | 1109 | 200.00 | 9 |
| 417 | HPV | 16 | 1 | 14 | B*5102 | NPCHTTKLL | 1110 | 146.41 | 9 |
| 418 | HPV | 16 | 1 | 14 | B*2705 | GRINCNSNT | 1111 | 200.00 | 9 |
| 419 | HPV | 16 | 1 | 14 | A68.1 | NTLKCLRYR | 1112 | 100.00 | 9 |
| 420 | HPV | 16 | 1 | 14 | B62 | TLKCLRYRF | 1113 | 120.00 | 9 |
| 421 | HPV | 16 | 1 | 14 | B*2705 | LRYRFKKHC | 1114 | 300.00 | 9 |
| 422 | HPV | 16 | 1 | 14 | B14 | YRFKKHCTL | 1115 | 100.00 | 9 |
| 423 | HPV | 16 | 1 | 14 | B*2702 | YRFKKHCTL | 1115 | 300.00 | 9 |
| 424 | HPV | 16 | 1 | 14 | B*2705 | YRFKKHCTL | 1115 | 10000.00 | 9 |
| 425 | HPV | 16 | 1 | 14 | B*2705 | SEWQRDQFL | 1116 | 150.00 | 9 |
| 426 | HPV | 16 | 1 | 14 | B60 | SEWQRDQFL | 1116 | 160.00 | 9 |
| 427 | HPV | 16 | 1 | 14 | B*2705 | QRDQFLSQV | 1117 | 600.00 | 9 |
| 428 | HPV | 16 | 1 | 14 | B*5801 | KTITVSTGF | 1118 | 180.00 | 9 |
| 429 | HPV | 16 | 1 | 14 | B*2705 | CQRLNVCQDK | 1333 | 200.00 | 10 |
| 430 | HPV | 16 | 1 | 14 | B*2705 | QRLNVCQDKI | 1334 | 600.00 | 10 |
| 431 | HPV | 16 | 1 | 14 | B*3901 | THYENDSTDL | 1335 | 360.00 | 10 |
| 432 | HPV | 16 | 1 | 14 | A1 | STDLRDHIDY | 1336 | 312.50 | 10 |
| 433 | HPV | 16 | 1 | 14 | B*2705 | LRDHIDYWKH | 1337 | 200.00 | 10 |
| 434 | HPV | 16 | 1 | 14 | B*2705 | MRLECAIYYK | 1338 | 2000.00 | 10 |
| 435 | HPV | 16 | 1 | 14 | Cw*0401 | IYYKAREMGF | 1339 | 110.00 | 10 |
| 436 | HPV | 16 | 1 | 14 | A24 | IYYKAREMGF | 1339 | 100.00 | 10 |
| 437 | HPV | 16 | 1 | 14 | B*5102 | KAREMGFKHI | 1340 | 133.10 | 10 |
| 438 | HPV | 16 | 1 | 14 | B*5103 | KAREMGFKHI | 1340 | 121.00 | 10 |
| 439 | HPV | 16 | 1 | 14 | B*2705 | AREMGFKHIN | 1341 | 200.00 | 10 |
| 440 | HPV | 16 | 1 | 14 | B*5102 | MGFKHINHQV | 1342 | 242.00 | 10 |
| 441 | HPV | 16 | 1 | 14 | A68.1 | QVVPTLAVSK | 1343 | 360.00 | 10 |
| 442 | HPV | 16 | 1 | 14 | B*5102 | KALQAIELQL | 1119 | 165.00 | 10 |
| 443 | HPV | 16 | 1 | 14 | B*2705 | LQAIELQLTL | 1120 | 200.00 | 10 |
| 444 | HPV | 16 | 1 | 14 | B*2705 | SQYSNEKWTL | 1121 | 1000.00 | 10 |
| 445 | HPV | 16 | 1 | 14 | B*2705 | LQDVSLEVYL | 1122 | 200.00 | 10 |
| 446 | HPV | 16 | 1 | 14 | B*2705 | VQFDGDICNT | 1123 | 100.00 | 10 |

TABLE 7-continued

| No | Species | Strain type | Frame | ORF | HLA | Seq | Seq ID No. | Score | Length |
|---|---|---|---|---|---|---|---|---|---|
| 447 | HPV | 16 | 1 | 14 | Cw*0401 | QFDGDICNTM | 1124 | 150.00 | 10 |
| 448 | HPV | 16 | 1 | 14 | A*0201 | YICEEASVTV | 1125 | 180.37 | 10 |
| 449 | HPV | 16 | 1 | 14 | B60 | VEGQVDYYGL | 1126 | 320.00 | 10 |
| 450 | HPV | 16 | 1 | 14 | B*2705 | GQVDYYGLYY | 1127 | 100.00 | 10 |
| 451 | HPV | 16 | 1 | 14 | B62 | GQVDYYGLYY | 1127 | 116.16 | 10 |
| 452 | HPV | 16 | 1 | 14 | B*5102 | YGLYYVHEGI | 1128 | 580.80 | 10 |
| 453 | HPV | 16 | 1 | 14 | A68.1 | FVQFKDDAEK | 1129 | 180.00 | 10 |
| 454 | HPV | 16 | 1 | 14 | B*2702 | VQFKDDAEKY | 1130 | 100.00 | 10 |
| 455 | HPV | 16 | 1 | 14 | B*2705 | VQFKDDAEKY | 1130 | 500.00 | 10 |
| 456 | HPV | 16 | 1 | 14 | B*5102 | DAEKYSKNKV | 1131 | 110.00 | 10 |
| 457 | HPV | 16 | 1 | 14 | B*5103 | DAEKYSKNKV | 1131 | 121.00 | 10 |
| 458 | HPV | 16 | 1 | 14 | B*2705 | IRQHLANHPA | 1132 | 200.00 | 10 |
| 459 | HPV | 16 | 1 | 14 | B*5102 | HPAATHTKAV | 1133 | 242.00 | 10 |
| 460 | HPV | 16 | 1 | 14 | B*5102 | LGTEETQTTI | 1134 | 117.13 | 10 |
| 461 | HPV | 16 | 1 | 14 | A68.1 | ETQTTIQRPR | 1135 | 150.00 | 10 |
| 462 | HPV | 16 | 1 | 14 | A68.1 | DTGNPCHTTK | 1136 | 180.00 | 10 |
| 463 | HPV | 16 | 1 | 14 | B*2705 | HRDSVDSAPI | 1137 | 600.00 | 10 |
| 464 | HPV | 16 | 1 | 14 | B*2705 | GRINCNSNTT | 1138 | 200.00 | 10 |
| 465 | HPV | 16 | 1 | 14 | B*3901 | VHLKGDANTL | 1139 | 180.00 | 10 |
| 466 | HPV | 16 | 1 | 14 | B*5801 | NTLKCLRYRF | 1140 | 145.20 | 10 |
| 467 | HPV | 16 | 1 | 14 | B*2702 | LRYRFKKHCT | 1141 | 100.00 | 10 |
| 468 | HPV | 16 | 1 | 14 | B*2705 | LRYRFKKHCT | 1141 | 1000.00 | 10 |
| 469 | HPV | 16 | 1 | 14 | Cw*0401 | RYRFKKHCTL | 1142 | 200.00 | 10 |
| 470 | HPV | 16 | 1 | 14 | A24 | RYRFKKHCTL | 1142 | 400.00 | 10 |
| 471 | HPV | 16 | 1 | 14 | B*2702 | YRFKKHCTLY | 1143 | 1000.00 | 10 |
| 472 | HPV | 16 | 1 | 14 | B*2705 | YRFKKHCTLY | 1143 | 5000.00 | 10 |
| 473 | HPV | 16 | 1 | 14 | B*2705 | QRDQFLSQVK | 1144 | 2000.00 | 10 |
| 474 | HPV | 16 | 1 | 16 | B*2705 | MQEHPDYL | 1344 | 200.00 | 8 |
| 475 | HPV | 16 | 1 | 16 | B*3901 | EHPDYLQL | 1345 | 270.00 | 8 |
| 476 | HPV | 16 | 1 | 16 | B*2705 | LQLDIPIF | 1346 | 100.00 | 8 |
| 477 | HPV | 16 | 1 | 16 | A*0201 | NMLHAQTYI | 1347 | 153.33 | 9 |
| 478 | HPV | 16 | 1 | 16 | A*0201 | IMQEHPDYL | 1348 | 289.81 | 9 |
| 479 | HPV | 16 | 1 | 16 | B60 | QEHPDYLQL | 1349 | 352.00 | 9 |
| 480 | HPV | 16 | 1 | 16 | B*5102 | HPDYLQLDI | 1350 | 220.00 | 9 |
| 481 | HPV | 16 | 1 | 16 | A*0201 | LQLDIPIFL | 1351 | 307.21 | 9 |
| 482 | HPV | 16 | 1 | 16 | B*2705 | LQLDIPIFL | 1351 | 200.00 | 9 |
| 483 | HPV | 16 | 1 | 16 | A*0201 | QLDIPIFLL | 1352 | 113.99 | 9 |
| 484 | HPV | 16 | 1 | 16 | Cw*0401 | IPIFLLKNL | 1353 | 160.00 | 9 |
| 485 | HPV | 16 | 1 | 16 | B*5102 | IPIFLLKNL | 1353 | 330.00 | 9 |
| 486 | HPV | 16 | 1 | 16 | A*0201 | FLLKNLTIT | 1354 | 119.60 | 9 |
| 487 | HPV | 16 | 1 | 16 | B*2705 | MQEHPDYLQL | 1355 | 200.00 | 10 |
| 488 | HPV | 16 | 1 | 16 | Cw*0401 | DYLQLDIPIF | 1356 | 200.00 | 10 |
| 489 | HPV | 16 | 1 | 16 | A24 | DYLQLDIPIF | 1356 | 150.00 | 10 |
| 490 | HPV | 16 | 1 | 16 | A*0201 | YLQLDIPIFL | 1357 | 540.47 | 10 |
| 491 | HPV | 16 | 1 | 16 | A*0201 | LQLDIPIFLL | 1358 | 745.13 | 10 |
| 492 | HPV | 16 | 1 | 16 | A*0205 | LQLDIPIFLL | 1358 | 205.63 | 10 |
| 493 | HPV | 16 | 1 | 16 | B*2705 | LQLDIPIFLL | 1358 | 200.00 | 10 |
| 494 | HPV | 16 | 1 | 16 | A3 | QLDIPIFLLK | 1359 | 180.00 | 10 |
| 495 | HPV | 16 | 1 | 16 | B62 | LLKNLTITKY | 1360 | 144.00 | 10 |
| 496 | HPV | 16 | 1 | 17 | A*0201 | KMLVLMQQM | 1361 | 106.87 | 9 |
| 497 | HPV | 16 | 1 | 17 | B*5201 | MQQMQVWII | 1362 | 150.00 | 9 |
| 498 | HPV | 16 | 1 | 17 | A68.1 | NVYLWITNK | 1363 | 120.00 | 9 |
| 499 | HPV | 16 | 1 | 17 | A*0201 | MLVLMQQMQV | 1364 | 118.24 | 10 |
| 500 | HPV | 16 | 1 | 17 | A*0201 | VLMQQMQVWI | 1365 | 360.92 | 10 |
| 501 | HPV | 16 | 1 | 17 | B*2705 | MQVWIIENVY | 1366 | 100.00 | 10 |
| 502 | HPV | 16 | 1 | 17 | A*0201 | WIIENVYLWI | 1367 | 223.20 | 10 |
| 503 | HPV | 16 | 1 | 17 | A*0201 | YLWITNKHNC | 1368 | 189.68 | 10 |
| 504 | HPV | 16 | 1 | 18 | B*5102 | LALVLWTL | 1165 | 150.00 | 8 |
| 505 | HPV | 16 | 1 | 18 | B*2705 | YRLTKVKF | 1166 | 300.00 | 8 |
| 506 | HPV | 16 | 1 | 18 | B*3901 | FHWIFVHL | 1167 | 270.00 | 8 |
| 507 | HPV | 16 | 1 | 18 | B*5102 | FANIQIIL | 1168 | 121.00 | 8 |
| 508 | HPV | 16 | 1 | 18 | B*5102 | MATAYFFI | 1169 | 200.00 | 8 |
| 509 | HPV | 16 | 1 | 18 | B*2705 | YQTIYTLK | 1170 | 200.00 | 8 |
| 510 | HPV | 16 | 1 | 18 | B*5102 | KALGLLQI | 1171 | 726.00 | 8 |
| 511 | HPV | 16 | 1 | 18 | A*0201 | VIWFILALV | 1369 | 310.36 | 9 |
| 512 | HPV | 16 | 1 | 18 | A*0201 | FILALVLWT | 1370 | 220.61 | 9 |
| 513 | HPV | 16 | 1 | 18 | A*0201 | ILALVLWTL | 1371 | 626.45 | 9 |
| 514 | HPV | 16 | 1 | 18 | B*5102 | LALVLWTLL | 1172 | 150.00 | 9 |
| 515 | HPV | 16 | 1 | 18 | A3 | TLLHYRLTK | 1173 | 180.00 | 9 |
| 516 | HPV | 16 | 1 | 18 | A*0201 | LLHYRLTKV | 1174 | 271.95 | 9 |
| 517 | HPV | 16 | 1 | 18 | A24 | HYRLTKVKF | 1175 | 110.00 | 9 |
| 518 | HPV | 16 | 1 | 18 | Cw*0401 | HYRLTKVKF | 1175 | 132.00 | 9 |
| 519 | HPV | 16 | 1 | 18 | Cw*0401 | KFHWIFVHL | 1176 | 330.00 | 9 |
| 520 | HPV | 16 | 1 | 18 | Cw*0401 | LFANIQIIL | 1177 | 200.00 | 9 |
| 521 | HPV | 16 | 1 | 18 | B*2705 | CQNHMATAY | 1178 | 100.00 | 9 |
| 522 | HPV | 16 | 1 | 18 | A*0201 | FIYEGNKCL | 1179 | 177.27 | 9 |

TABLE 7-continued

| No | Species | Strain type | Frame | ORF | HLA | Seq | Seq ID No. | Score | Length |
|---|---|---|---|---|---|---|---|---|---|
| 523 | HPV | 16 | 1 | 18 | A*0205 | FIYEGNKCL | 1179 | 189.00 | 9 |
| 524 | HPV | 16 | 1 | 18 | A24 | IYEGNKCLL | 1180 | 300.00 | 9 |
| 525 | HPV | 16 | 1 | 18 | Cw*0401 | IYEGNKCLL | 1180 | 200.00 | 9 |
| 526 | HPV | 16 | 1 | 18 | A24 | IYLIGLVLL | 1181 | 300.00 | 9 |
| 527 | HPV | 16 | 1 | 18 | Cw*0401 | IYLIGLVLL | 1181 | 400.00 | 9 |
| 528 | HPV | 16 | 1 | 18 | A*0201 | YLIGLVLLV | 1182 | 735.86 | 9 |
| 529 | HPV | 16 | 1 | 18 | A*0201 | VLLVKMYQT | 1183 | 107.81 | 9 |
| 530 | HPV | 16 | 1 | 18 | A*0201 | KMYQTIYTL | 1184 | 397.44 | 9 |
| 531 | HPV | 16 | 1 | 18 | A*0205 | KMYQTIYTL | 1184 | 126.00 | 9 |
| 532 | HPV | 16 | 1 | 18 | B*2705 | KMYQTIYTL | 1184 | 750.00 | 9 |
| 533 | HPV | 16 | 1 | 18 | A24 | IYTLKALGL | 1185 | 200.00 | 9 |
| 534 | HPV | 16 | 1 | 18 | Cw*0401 | IYTLKALGL | 1185 | 200.00 | 9 |
| 535 | HPV | 16 | 1 | 18 | A*0201 | FILALVLWTL | 1372 | 862.39 | 10 |
| 536 | HPV | 16 | 1 | 18 | A*0205 | FILALVLWTL | 1372 | 151.20 | 10 |
| 537 | HPV | 16 | 1 | 18 | A68.1 | LVLWTLLHYR | 1186 | 400.00 | 10 |
| 538 | HPV | 16 | 1 | 18 | A*0201 | VLWTLLHYRL | 1187 | 301.42 | 10 |
| 539 | HPV | 16 | 1 | 18 | B*2705 | VLWTLLHYRL | 1187 | 150.00 | 10 |
| 540 | HPV | 16 | 1 | 18 | A*0201 | TLLHYRLTKV | 1188 | 591.89 | 10 |
| 541 | HPV | 16 | 1 | 18 | B*2702 | YRLTKVKFHW | 1189 | 100.00 | 10 |
| 542 | HPV | 16 | 1 | 18 | B*2705 | YRLTKVKFHW | 1189 | 200.00 | 10 |
| 543 | HPV | 16 | 1 | 18 | A*0201 | RLTKVKFHWI | 1190 | 109.02 | 10 |
| 544 | HPV | 16 | 1 | 18 | Cw*0401 | KFHWIFVHLF | 1191 | 300.00 | 10 |
| 545 | HPV | 16 | 1 | 18 | B*2705 | HLFANIQIIL | 1192 | 150.00 | 10 |
| 546 | HPV | 16 | 1 | 18 | B*2705 | CQNHMATAYF | 1193 | 100.00 | 10 |
| 547 | HPV | 16 | 1 | 18 | A3 | HMATAYFFIY | 1194 | 108.00 | 10 |
| 548 | HPV | 16 | 1 | 18 | Cw*0401 | FFIYEGNKCL | 1195 | 200.00 | 10 |
| 549 | HPV | 16 | 1 | 18 | A*0201 | FIYEGNKCLL | 1196 | 177.27 | 10 |
| 550 | HPV | 16 | 1 | 18 | A*0205 | FIYEGNKCLL | 1196 | 189.00 | 10 |
| 551 | HPV | 16 | 1 | 18 | A*0201 | CLLDIYLIGL | 1197 | 745.36 | 10 |
| 552 | HPV | 16 | 1 | 18 | A*0205 | CLLDIYLIGL | 1197 | 151.20 | 10 |
| 553 | HPV | 16 | 1 | 18 | A3 | YLIGLVLLVK | 1198 | 202.50 | 10 |
| 554 | HPV | 16 | 1 | 18 | A3 | KMYQTIYTLK | 1199 | 450.00 | 10 |
| 555 | HPV | 16 | 1 | 18 | B*2705 | KMYQTIYTLK | 1199 | 750.00 | 10 |
| 556 | HPV | 16 | 1 | 18 | Cw*0401 | IYTLKALGLL | 1200 | 440.00 | 10 |
| 557 | HPV | 16 | 1 | 18 | A24 | IYTLKALGLL | 1200 | 200.00 | 10 |
| 558 | HPV | 16 | 1 | 19 | B*2705 | HRATIMAF | 1201 | 1000.00 | 8 |
| 559 | HPV | 16 | 1 | 19 | B*5102 | RATIMAFV | 1202 | 100.00 | 8 |
| 560 | HPV | 16 | 1 | 19 | B*2705 | TNYLLLLL | 1203 | 100.00 | 8 |
| 561 | HPV | 16 | 1 | 19 | B*2705 | VQICHYVL | 1204 | 200.00 | 8 |
| 562 | HPV | 16 | 1 | 19 | B*3901 | CHYVLPYL | 1205 | 180.00 | 8 |
| 563 | HPV | 16 | 1 | 19 | B*5102 | LPYLLQKL | 1206 | 665.50 | 8 |
| 564 | HPV | 16 | 1 | 19 | B*3901 | LHIKILTL | 1207 | 270.00 | 8 |
| 565 | HPV | 16 | 1 | 19 | B*2705 | GRNMIYSL | 1208 | 2000.00 | 8 |
| 566 | HPV | 16 | 1 | 19 | B*2705 | SLFFNCAK | 1209 | 150.00 | 8 |
| 567 | HPV | 16 | 1 | 19 | B*5102 | MPKYSINLI | 1210 | 220.00 | 9 |
| 568 | HPV | 16 | 1 | 19 | B*2705 | HRATIMAFV | 1211 | 600.00 | 9 |
| 569 | HPV | 16 | 1 | 19 | Cw*0401 | AFVGVTNYL | 1212 | 200.00 | 9 |
| 570 | HPV | 16 | 1 | 19 | Cw*0301 | VGVTNYLLL | 1213 | 120.00 | 9 |
| 571 | HPV | 16 | 1 | 19 | A24 | NYLLLLLIL | 1214 | 360.00 | 9 |
| 572 | HPV | 16 | 1 | 19 | Cw*0401 | NYLLLLLIL | 1214 | 400.00 | 9 |
| 573 | HPV | 16 | 1 | 19 | A*0201 | LLLLILHAV | 1215 | 1006.21 | 9 |
| 574 | HPV | 16 | 1 | 19 | B*5103 | HAVQICHYV | 1216 | 110.00 | 9 |
| 575 | HPV | 16 | 1 | 19 | B*5102 | HAVQICHYV | 1216 | 363.00 | 9 |
| 576 | HPV | 16 | 1 | 19 | B*3901 | CHYVLPYLL | 1217 | 180.00 | 9 |
| 577 | HPV | 16 | 1 | 19 | A68.1 | YVLPYLLQK | 1218 | 360.00 | 9 |
| 578 | HPV | 16 | 1 | 19 | A*0201 | KLHIKILTL | 1219 | 171.97 | 9 |
| 579 | HPV | 16 | 1 | 19 | B*2705 | LRSTYDMGR | 1220 | 1000.00 | 9 |
| 580 | HPV | 16 | 1 | 19 | B*2702 | GRNMIYSLF | 1221 | 200.00 | 9 |
| 581 | HPV | 16 | 1 | 19 | B*2705 | GRNMIYSLF | 1221 | 1000.00 | 9 |
| 582 | HPV | 16 | 1 | 19 | B*5102 | IGYNEHRATI | 1222 | 484.00 | 10 |
| 583 | HPV | 16 | 1 | 19 | B*5103 | IGYNEHRATI | 1222 | 132.00 | 10 |
| 584 | HPV | 16 | 1 | 19 | Cw*0401 | GYNEHRATIM | 1223 | 132.00 | 10 |
| 585 | HPV | 16 | 1 | 19 | B*5102 | RATIMAFVGV | 1224 | 100.00 | 10 |
| 586 | HPV | 16 | 1 | 19 | B*5103 | RATIMAFVGV | 1224 | 121.00 | 10 |
| 587 | HPV | 16 | 1 | 19 | B*5102 | MAFVGVTNYL | 1225 | 332.75 | 10 |
| 588 | HPV | 16 | 1 | 19 | Cw*0401 | AFVGVTNYLL | 1226 | 240.00 | 10 |
| 589 | HPV | 16 | 1 | 19 | B*2705 | TNYLLLLLIL | 1227 | 100.00 | 10 |
| 590 | HPV | 16 | 1 | 19 | A*0201 | YLLLLLILHA | 1228 | 194.48 | 10 |
| 591 | HPV | 16 | 1 | 19 | A*0201 | LLLLLILHAV | 1229 | 1006.21 | 10 |
| 592 | HPV | 16 | 1 | 19 | B*5102 | HAVQICHYVL | 1230 | 165.00 | 10 |
| 593 | HPV | 16 | 1 | 19 | B*2705 | VQICHYVLPY | 1231 | 100.00 | 10 |
| 594 | HPV | 16 | 1 | 19 | A*0205 | YVLPYLLQKL | 1232 | 252.00 | 10 |
| 595 | HPV | 16 | 1 | 19 | Cw*0301 | YVLPYLLQKL | 1232 | 120.00 | 10 |
| 596 | HPV | 16 | 1 | 19 | B*5102 | LPYLLQKLHI | 1233 | 2420.00 | 10 |
| 597 | HPV | 16 | 1 | 19 | B*5103 | LPYLLQKLHI | 1233 | 159.72 | 10 |
| 598 | HPV | 16 | 1 | 19 | A*0201 | YLLQKLHIKI | 1234 | 177.57 | 10 |

TABLE 7-continued

| No | Species | Strain type | Frame | ORF | HLA | Seq | Seq ID No. | Score | Length |
|---|---|---|---|---|---|---|---|---|---|
| 599 | HPV | 16 | 1 | 19 | B*2705 | LRSTYDMGRN | 1235 | 200.00 | 10 |
| 600 | HPV | 16 | 1 | 19 | B*2702 | GRNMIYSLFF | 1236 | 200.00 | 10 |
| 601 | HPV | 16 | 1 | 19 | B*2705 | GRNMIYSLFF | 1236 | 1000.00 | 10 |
| 602 | HPV | 16 | 1 | 21 | A*0201 | VLFVVYMFV | 1240 | 3609.23 | 9 |
| 603 | HPV | 16 | 1 | 21 | Cw*0401 | VYMFVCACM | 1241 | 120.00 | 9 |
| 604 | HPV | 16 | 1 | 21 | Cw*0401 | MFVCACMCL | 1242 | 220.00 | 9 |
| 605 | HPV | 16 | 1 | 21 | A*0201 | LVLFVVYMFV | 1245 | 315.81 | 10 |
| 606 | HPV | 16 | 1 | 21 | A*0201 | VLFVVYMFVC | 1246 | 170.91 | 10 |
| 607 | HPV | 16 | 1 | 21 | A*0201 | YMFVCACMCL | 1247 | 262.59 | 10 |
| 608 | HPV | 16 | 1 | 21 | B*2705 | YMFVCACMCL | 1247 | 250.00 | 10 |
| 609 | HPV | 16 | 1 | 22 | B*5102 | YGIINTCV | 1373 | 290.40 | 8 |
| 610 | HPV | 16 | 1 | 22 | Cw*0301 | TCVCVFKCL | 1374 | 120.00 | 9 |
| 611 | HPV | 16 | 1 | 22 | B*2705 | CNYCVMQHK | 1375 | 100.00 | 9 |
| 612 | HPV | 16 | 1 | 22 | A*0201 | CMYGIINTCV | 1376 | 160.74 | 10 |
| 613 | HPV | 16 | 1 | 22 | B*5102 | YGIINTCVCV | 1377 | 264.00 | 10 |
| 614 | HPV | 16 | 1 | 23 | Cw*0401 | LFGTKCVFL | 1378 | 200.00 | 9 |
| 615 | HPV | 16 | 1 | 23 | A*0201 | MLFGTKCVFL | 1379 | 739.03 | 10 |
| 616 | HPV | 16 | 1 | 23 | B*2705 | MLFGTKCVFL | 1379 | 150.00 | 10 |
| 617 | HPV | 16 | 1 | 24 | B*5102 | APTPYIPL | 1380 | 110.00 | 8 |
| 618 | HPV | 16 | 1 | 24 | B*5102 | YAPTPYIPL | 1381 | 110.00 | 9 |
| 619 | HPV | 16 | 1 | 24 | B7 | APTPYIPLL | 1382 | 240.00 | 9 |
| 620 | HPV | 16 | 1 | 24 | Cw*0401 | APTPYIPLL | 1382 | 192.00 | 9 |
| 621 | HPV | 16 | 1 | 24 | B*5102 | APTPYIPLL | 1382 | 110.00 | 9 |
| 622 | HPV | 16 | 1 | 24 | A*0201 | LLGTYFWLV | 1251 | 1684.90 | 9 |
| 623 | HPV | 16 | 1 | 24 | Cw*0401 | YFWLVLTNL | 1252 | 400.00 | 9 |
| 624 | HPV | 16 | 1 | 24 | A*0201 | VLTNLIAYL | 1253 | 459.40 | 9 |
| 625 | HPV | 16 | 1 | 24 | Cw*0401 | HYAPTPYIPL | 1383 | 240.00 | 10 |
| 626 | HPV | 16 | 1 | 24 | A24 | HYAPTPYIPL | 1383 | 240.00 | 10 |
| 627 | HPV | 16 | 1 | 24 | B*5102 | YAPTPYIPLL | 1384 | 121.00 | 10 |
| 628 | HPV | 16 | 1 | 24 | B*5102 | IPLLGTYFWL | 1385 | 363.00 | 10 |
| 629 | HPV | 16 | 1 | 24 | Cw*0301 | IPLLGTYFWL | 1385 | 100.00 | 10 |
| 630 | HPV | 16 | 1 | 24 | Cw*0401 | TYFWLVLTNL | 1254 | 400.00 | 10 |
| 631 | HPV | 16 | 1 | 24 | A24 | TYFWLVLTNL | 1254 | 280.00 | 10 |
| 632 | HPV | 16 | 1 | 24 | A*0201 | LVLTNLIAYL | 1255 | 148.73 | 10 |
| 633 | HPV | 16 | 1 | 24 | A*0205 | LVLTNLIAYL | 1255 | 142.80 | 10 |
| 634 | HPV | 16 | 2 | 1 | B*2705 | LRREVYDF | 1386 | 1000.00 | 8 |
| 635 | HPV | 16 | 2 | 1 | B*2705 | RREVYDFA | 1387 | 600.00 | 8 |
| 636 | HPV | 16 | 2 | 1 | B*5102 | FAFRDLCI | 1388 | 2200.00 | 8 |
| 637 | HPV | 16 | 2 | 1 | B*2705 | FRDLCIVY | 1389 | 1000.00 | 8 |
| 638 | HPV | 16 | 2 | 1 | B*2705 | YRDGNPYA | 1390 | 200.00 | 8 |
| 639 | HPV | 16 | 2 | 1 | B*5102 | YAVCDKCL | 1391 | 300.00 | 8 |
| 640 | HPV | 16 | 2 | 1 | B*2705 | YRHYCYSL | 1392 | 2000.00 | 8 |
| 641 | HPV | 16 | 2 | 1 | B*2705 | QQYNKPLC | 1393 | 100.00 | 8 |
| 642 | HPV | 16 | 2 | 1 | B*5102 | KPLCDLLI | 1394 | 1200.00 | 8 |
| 643 | HPV | 16 | 2 | 1 | B*2705 | IRCINCQK | 1395 | 2000.00 | 8 |
| 644 | HPV | 16 | 2 | 1 | B*2705 | KQRHLDKK | 1396 | 180.00 | 8 |
| 645 | HPV | 16 | 2 | 1 | B*2705 | KQRFHNIR | 1397 | 300.00 | 8 |
| 646 | HPV | 16 | 2 | 1 | B*2705 | IRGRWTGR | 1398 | 1000.00 | 8 |
| 647 | HPV | 16 | 2 | 1 | B*2705 | GRWTGRCM | 1399 | 3000.00 | 8 |
| 648 | HPV | 16 | 2 | 1 | B*2705 | GRCMSCCR | 1400 | 1000.00 | 8 |
| 649 | HPV | 16 | 2 | 1 | B*2705 | CRSSRTRR | 1401 | 300.00 | 8 |
| 650 | HPV | 16 | 2 | 1 | B*5201 | LQTTIHDII | 1402 | 300.00 | 9 |
| 651 | HPV | 16 | 2 | 1 | B*3901 | IHDIILECV | 1403 | 135.00 | 9 |
| 652 | HPV | 16 | 2 | 1 | B*2705 | QQLLRREVY | 1404 | 100.00 | 9 |
| 653 | HPV | 16 | 2 | 1 | B62 | LLRREVYDF | 1405 | 120.00 | 9 |
| 654 | HPV | 16 | 2 | 1 | B*2705 | LRREVYDFA | 1406 | 200.00 | 9 |
| 655 | HPV | 16 | 2 | 1 | B*2702 | RREVYDFAF | 1407 | 600.00 | 9 |
| 656 | HPV | 16 | 2 | 1 | B*2705 | RREVYDFAF | 1407 | 3000.00 | 9 |
| 657 | HPV | 16 | 2 | 1 | A24 | VYDFAFRDL | 1408 | 240.00 | 9 |
| 658 | HPV | 16 | 2 | 1 | Cw*0401 | VYDFAFRDL | 1408 | 330.00 | 9 |
| 659 | HPV | 16 | 2 | 1 | B*5103 | FAFRDLCIV | 1409 | 132.00 | 9 |
| 660 | HPV | 16 | 2 | 1 | B*5102 | FAFRDLCIV | 1409 | 1100.00 | 9 |
| 661 | HPV | 16 | 2 | 1 | B*2705 | FRDLCIVYR | 1410 | 1000.00 | 9 |
| 662 | HPV | 16 | 2 | 1 | B*2705 | YRDGNPYAV | 1411 | 600.00 | 9 |
| 663 | HPV | 16 | 2 | 1 | B*5102 | NPYAVCDKC | 1412 | 110.00 | 9 |
| 664 | HPV | 16 | 2 | 1 | A1 | ISEYRHYCY | 1413 | 135.00 | 9 |
| 665 | HPV | 16 | 2 | 1 | A24 | EYRHYCYSL | 1414 | 200.00 | 9 |
| 666 | HPV | 16 | 2 | 1 | Cw*0401 | EYRHYCYSL | 1414 | 220.00 | 9 |
| 667 | HPV | 16 | 2 | 1 | B*2702 | YRHYCYSLY | 1415 | 200.00 | 9 |
| 668 | HPV | 16 | 2 | 1 | B*2705 | YRHYCYSLY | 1415 | 1000.00 | 9 |
| 669 | HPV | 16 | 2 | 1 | A24 | CYSLYGTTL | 1416 | 200.00 | 9 |
| 670 | HPV | 16 | 2 | 1 | Cw*0401 | CYSLYGTTL | 1416 | 200.00 | 9 |
| 671 | HPV | 16 | 2 | 1 | B60 | LEQQYNKPL | 1417 | 160.00 | 9 |
| 672 | HPV | 16 | 2 | 1 | A24 | QYNKPLCDL | 1418 | 300.00 | 9 |
| 673 | HPV | 16 | 2 | 1 | Cw*0401 | QYNKPLCDL | 1418 | 400.00 | 9 |
| 674 | HPV | 16 | 2 | 1 | Cw*0401 | CPEEKQRHL | 1419 | 105.60 | 9 |

TABLE 7-continued

| No | Species | Strain type | Frame | ORF | HLA | Seq | Seq ID No. | Score | Length |
|---|---|---|---|---|---|---|---|---|---|
| 675 | HPV | 16 | 2 | 1 | B*2705 | QRHLDKKQR | 1420 | 300.00 | 9 |
| 676 | HPV | 16 | 2 | 1 | B*2705 | QRFHNIRGR | 1421 | 1500.00 | 9 |
| 677 | HPV | 16 | 2 | 1 | B*2705 | IRGRWTGRC | 1422 | 200.00 | 9 |
| 678 | HPV | 16 | 2 | 1 | B*2705 | GRWTGRCMS | 1423 | 1000.00 | 9 |
| 679 | HPV | 16 | 2 | 1 | B*2705 | GRCMSCCRS | 1424 | 200.00 | 9 |
| 680 | HPV | 16 | 2 | 1 | B14 | SRTRRETQL | 1425 | 300.00 | 9 |
| 681 | HPV | 16 | 2 | 1 | B*2705 | SRTRRETQL | 1425 | 2000.00 | 9 |
| 682 | HPV | 16 | 2 | 1 | B*2705 | LQTTIHDIIL | 1426 | 200.00 | 10 |
| 683 | HPV | 16 | 2 | 1 | B60 | LECVYCKQQL | 1427 | 176.00 | 10 |
| 684 | HPV | 16 | 2 | 1 | A68.1 | CVYCKQQLLR | 1428 | 200.00 | 10 |
| 685 | HPV | 16 | 2 | 1 | B*2705 | KQQLLRREVY | 1429 | 300.00 | 10 |
| 686 | HPV | 16 | 2 | 1 | B*2702 | LRREVYDFAF | 1430 | 200.00 | 10 |
| 687 | HPV | 16 | 2 | 1 | B*2705 | LRREVYDFAF | 1430 | 1000.00 | 10 |
| 688 | HPV | 16 | 2 | 1 | B*2705 | RREVYDFAFR | 1431 | 3000.00 | 10 |
| 689 | HPV | 16 | 2 | 1 | Cw*0301 | EVYDFAFRDL | 1432 | 100.00 | 10 |
| 690 | HPV | 16 | 2 | 1 | B*2705 | YRDGNPYAVC | 1433 | 200.00 | 10 |
| 691 | HPV | 16 | 2 | 1 | B*5102 | NPYAVCDKCL | 1434 | 550.00 | 10 |
| 692 | HPV | 16 | 2 | 1 | B*2705 | SEYRHYCYSL | 1435 | 150.00 | 10 |
| 693 | HPV | 16 | 2 | 1 | B60 | SEYRHYCYSL | 1435 | 320.00 | 10 |
| 694 | HPV | 16 | 2 | 1 | B*2705 | QQYNKPLCDL | 1436 | 1000.00 | 10 |
| 695 | HPV | 16 | 2 | 1 | Cw*0401 | QYNKPLCDLL | 1437 | 200.00 | 10 |
| 696 | HPV | 16 | 2 | 1 | A24 | QYNKPLCDLL | 1437 | 360.00 | 10 |
| 697 | HPV | 16 | 2 | 1 | B*2705 | IRCINCQKPL | 1438 | 600.00 | 10 |
| 698 | HPV | 16 | 2 | 1 | B*2705 | CQKPLCPEEK | 1439 | 200.00 | 10 |
| 699 | HPV | 16 | 2 | 1 | B*2702 | QRHLDKKQRF | 1440 | 200.00 | 10 |
| 700 | HPV | 16 | 2 | 1 | B*2705 | QRHLDKKQRF | 1440 | 1000.00 | 10 |
| 701 | HPV | 16 | 2 | 1 | B*2702 | QRFHNIRGRW | 1441 | 500.00 | 10 |
| 702 | HPV | 16 | 2 | 1 | B*2705 | QRFHNIRGRW | 1441 | 1000.00 | 10 |
| 703 | HPV | 16 | 2 | 1 | B*2705 | IRGRWTGRCM | 1442 | 180.00 | 10 |
| 704 | HPV | 16 | 2 | 1 | B*2702 | GRWTGRCMSC | 1443 | 100.00 | 10 |
| 705 | HPV | 16 | 2 | 1 | B*2705 | GRWTGRCMSC | 1443 | 1000.00 | 10 |
| 706 | HPV | 16 | 2 | 1 | A68.1 | WTGRCMSCCR | 1444 | 100.00 | 10 |
| 707 | HPV | 16 | 2 | 3 | B*2705 | KQNRTEPI | 1445 | 180.00 | 8 |
| 708 | HPV | 16 | 2 | 3 | B*2705 | NRTEPITI | 1446 | 600.00 | 8 |
| 709 | HPV | 16 | 2 | 3 | B*2705 | NRTEPITIL | 1447 | 2000.00 | 9 |
| 710 | HPV | 16 | 2 | 3 | B*2705 | KQNRTEPITI | 1448 | 180.00 | 10 |
| 711 | HPV | 16 | 2 | 4 | B*2705 | VRDVMDGF | 1449 | 1000.00 | 8 |
| 712 | HPV | 16 | 2 | 4 | A68.1 | QVPMGKRVR | 1450 | 200.00 | 9 |
| 713 | HPV | 16 | 2 | 4 | B*2705 | VRDVMDGFM | 1451 | 600.00 | 9 |
| 714 | HPV | 16 | 2 | 4 | A*0201 | ILQVPMGKRV | 1452 | 118.24 | 10 |
| 715 | HPV | 16 | 2 | 4 | B*5102 | VPMGKRVRDV | 1453 | 242.00 | 10 |
| 716 | HPV | 16 | 2 | 4 | B*2702 | KRVRDVMDGF | 1454 | 600.00 | 10 |
| 717 | HPV | 16 | 2 | 4 | B*2705 | KRVRDVMDGF | 1454 | 3000.00 | 10 |
| 718 | HPV | 16 | 2 | 5 | B*2705 | HRKQNNIEM | 1455 | 600.00 | 9 |
| 719 | HPV | 16 | 2 | 5 | B*2705 | KQNNIEMQY | 1456 | 300.00 | 9 |
| 720 | HPV | 16 | 2 | 5 | B*2705 | KQNNIEMQYR | 1457 | 300.00 | 10 |
| 721 | HPV | 16 | 2 | 6 | B*2705 | ARGRGQGK | 1458 | 2000.00 | 8 |
| 722 | HPV | 16 | 2 | 6 | B*2705 | KRWRLFAN | 1459 | 3000.00 | 8 |
| 723 | HPV | 16 | 2 | 6 | A68.1 | DVVQIKFAR | 1460 | 1200.00 | 9 |
| 724 | HPV | 16 | 2 | 6 | B*2705 | ARGRGQGKR | 1461 | 1000.00 | 9 |
| 725 | HPV | 16 | 2 | 6 | B*2705 | GRGQGKRWR | 1462 | 300.00 | 9 |
| 726 | HPV | 16 | 2 | 6 | B62 | GQGKRWRLF | 1463 | 160.00 | 9 |
| 727 | HPV | 16 | 2 | 6 | B*2702 | KRWRLFANV | 1464 | 300.00 | 9 |
| 728 | HPV | 16 | 2 | 6 | B*2705 | KRWRLFANV | 1464 | 9000.00 | 9 |
| 729 | HPV | 16 | 2 | 6 | A*0201 | ILFLKDVVQI | 1465 | 150.93 | 10 |
| 730 | HPV | 16 | 2 | 6 | B62 | FLKDVVQIKF | 1466 | 316.80 | 10 |
| 731 | HPV | 16 | 2 | 6 | A68.1 | VVQIKFARGR | 1467 | 200.00 | 10 |
| 732 | HPV | 16 | 2 | 6 | B14 | GRGQGKRWRL | 1468 | 100.00 | 10 |
| 733 | HPV | 16 | 2 | 6 | B*2705 | GRGQGKRWRL | 1468 | 2000.00 | 10 |
| 734 | HPV | 16 | 2 | 7 | B*2705 | YQRIKHYK | 1469 | 200.00 | 8 |
| 735 | HPV | 16 | 2 | 7 | B14 | QRIKHYKQL | 1470 | 180.00 | 9 |
| 736 | HPV | 16 | 2 | 7 | B*2705 | QRIKHYKQL | 1470 | 600.00 | 9 |
| 737 | HPV | 16 | 2 | 7 | Cw*0301 | QRIKHYKQL | 1470 | 240.00 | 9 |
| 738 | HPV | 16 | 2 | 7 | B*2705 | QRIKHYKQLN | 1471 | 200.00 | 10 |
| 739 | HPV | 16 | 2 | 8 | B*2705 | TQWTVLQS | 1472 | 100.00 | 8 |
| 740 | HPV | 16 | 2 | 8 | Cw*0301 | TKYPLLKLL | 1473 | 120.00 | 9 |
| 741 | HPV | 16 | 2 | 8 | A*0201 | KLLGSTWPT | 1474 | 723.78 | 9 |
| 742 | HPV | 16 | 2 | 8 | B*5102 | WPTTPPRPI | 1475 | 484.00 | 9 |
| 743 | HPV | 16 | 2 | 8 | B*5102 | WAPKKHRRL | 1476 | 121.00 | 9 |
| 744 | HPV | 16 | 2 | 8 | B*2705 | TQWTVLQSS | 1477 | 100.00 | 9 |
| 745 | HPV | 16 | 2 | 8 | B*5102 | AATKYPLLKL | 1478 | 110.00 | 10 |
| 746 | HPV | 16 | 2 | 8 | A*0201 | KLLGSTWPTT | 1479 | 164.06 | 10 |
| 747 | HPV | 16 | 2 | 8 | B*2705 | RRLSSDQDQS | 1480 | 600.00 | 10 |
| 748 | HPV | 16 | 2 | 8 | B*2705 | TQWTVLQSSL | 1481 | 1000.00 | 10 |
| 749 | HPV | 16 | 2 | 8 | B*5102 | TAHTKDGLTV | 1482 | 121.00 | 10 |
| 750 | HPV | 16 | 2 | 8 | B*5103 | TAHTKDGLTV | 1482 | 121.00 | 10 |

TABLE 7-continued

| No | Species | Strain type | Frame | ORF | HLA | Seq | Seq ID No. | Score | Length |
|---|---|---|---|---|---|---|---|---|---|
| 751 | HPV | 16 | 2 | 9 | B*2705 | CRLHGIGQDI | 1483 | 600.00 | 10 |
| 752 | HPV | 16 | 2 | 11 | B*5102 | SAFRCFIV | 1484 | 550.00 | 8 |
| 753 | HPV | 16 | 2 | 11 | B*2705 | FRCFIVYI | 1485 | 600.00 | 8 |
| 754 | HPV | 16 | 2 | 11 | A*0201 | LLLSVSTYT | 1486 | 257.80 | 9 |
| 755 | HPV | 16 | 2 | 11 | Cw*0301 | LSVSTYTSL | 1487 | 100.00 | 9 |
| 756 | HPV | 16 | 2 | 11 | A*0201 | IILVLLLWI | 1488 | 114.14 | 9 |
| 757 | HPV | 16 | 2 | 11 | B*5103 | AASAFRCFI | 1489 | 100.00 | 9 |
| 758 | HPV | 16 | 2 | 11 | B*5102 | AASAFRCFI | 1489 | 200.00 | 9 |
| 759 | HPV | 16 | 2 | 11 | B*2705 | FRCFIVYII | 1490 | 600.00 | 9 |
| 760 | HPV | 16 | 2 | 11 | Cw*0301 | YIIFVYIPL | 1491 | 100.00 | 9 |
| 761 | HPV | 16 | 2 | 11 | Cw*0401 | IFVYIPLFL | 1492 | 200.00 | 9 |
| 762 | HPV | 16 | 2 | 11 | A*0201 | FVYIPLFLI | 1493 | 179.26 | 9 |
| 763 | HPV | 16 | 2 | 11 | Cw*0401 | TYTSLIILVL | 1494 | 400.00 | 10 |
| 764 | HPV | 16 | 2 | 11 | A24 | TYTSLIILVL | 1494 | 280.00 | 10 |
| 765 | HPV | 16 | 2 | 11 | B*5102 | TAASAFRCFI | 1495 | 200.00 | 10 |
| 766 | HPV | 16 | 2 | 11 | B*5103 | TAASAFRCFI | 1495 | 110.00 | 10 |
| 767 | HPV | 16 | 2 | 11 | B*5102 | AASAFRCFIV | 1496 | 100.00 | 10 |
| 768 | HPV | 16 | 2 | 11 | B*5103 | AASAFRCFIV | 1496 | 110.00 | 10 |
| 769 | HPV | 16 | 2 | 11 | B*5102 | SAFRCFIVYI | 1497 | 1331.00 | 10 |
| 770 | HPV | 16 | 2 | 11 | B*5103 | SAFRCFIVYI | 1497 | 159.72 | 10 |
| 771 | HPV | 16 | 2 | 11 | B*2702 | FRCFIVYIIF | 1498 | 200.00 | 10 |
| 772 | HPV | 16 | 2 | 11 | B*2705 | FRCFIVYIIF | 1498 | 1000.00 | 10 |
| 773 | HPV | 16 | 2 | 11 | Cw*0301 | VYIIFVYIPL | 1499 | 100.00 | 10 |
| 774 | HPV | 16 | 2 | 11 | Cw*0401 | VYIIFVYIPL | 1499 | 200.00 | 10 |
| 775 | HPV | 16 | 2 | 11 | A24 | VYIIFVYIPL | 1499 | 420.00 | 10 |
| 776 | HPV | 16 | 2 | 11 | A*0201 | IIFVYIPLFL | 1500 | 101.62 | 10 |
| 777 | HPV | 16 | 2 | 11 | Cw*0401 | LFLIHTHARF | 1501 | 144.00 | 10 |
| 778 | HPV | 16 | 2 | 11 | A*0201 | FLIHTHARFL | 1502 | 108.09 | 10 |
| 779 | HPV | 16 | 2 | 12 | B*2705 | QRIPMYQC | 1503 | 200.00 | 8 |
| 780 | HPV | 16 | 2 | 12 | B*2705 | YQCCSKSR | 1504 | 100.00 | 8 |
| 781 | HPV | 16 | 2 | 12 | B*2705 | QRIPMYQCC | 1505 | 200.00 | 9 |
| 782 | HPV | 16 | 2 | 12 | B*2705 | QRIPMYQCCS | 1506 | 200.00 | 10 |
| 783 | HPV | 16 | 2 | 13 | B*2705 | RRHTRRYL | 1507 | 6000.00 | 8 |
| 784 | HPV | 16 | 2 | 13 | B*3501 | SPRRHTRRY | 1508 | 120.00 | 9 |
| 785 | HPV | 16 | 2 | 13 | B7 | SPRRHTRRYL | 1509 | 1200.00 | 10 |
| 786 | HPV | 16 | 2 | 14 | B*2705 | MRAKSLFS | 1510 | 200.00 | 8 |
| 787 | HPV | 16 | 2 | 15 | Cw*0301 | HSIVFYTAL | 1511 | 100.00 | 9 |
| 788 | HPV | 16 | 2 | 15 | B*5102 | TALCATTESL | 1512 | 199.65 | 10 |
| 789 | HPV | 16 | 2 | 2 | B*2705 | HQKRTAMF | 1513 | 100.00 | 8 |
| 790 | HPV | 16 | 2 | 2 | B*3501 | RPRKLPQL | 1514 | 120.00 | 8 |
| 791 | HPV | 16 | 2 | 2 | B*5102 | LPQLCTEL | 1515 | 133.10 | 8 |
| 792 | HPV | 16 | 2 | 2 | B*2705 | LRREVYDF | 1386 | 1000.00 | 8 |
| 793 | HPV | 16 | 2 | 2 | B*2705 | RREVYDFA | 1387 | 600.00 | 8 |
| 794 | HPV | 16 | 2 | 2 | B*5102 | FAFRDLCI | 1388 | 2200.00 | 8 |
| 795 | HPV | 16 | 2 | 2 | B*2705 | FRDLCIVY | 1389 | 1000.00 | 8 |
| 796 | HPV | 16 | 2 | 2 | B*2705 | YRDGNPYA | 1390 | 200.00 | 8 |
| 797 | HPV | 16 | 2 | 2 | B*5102 | YAVCDKCL | 1391 | 300.00 | 8 |
| 798 | HPV | 16 | 2 | 2 | B*2705 | YRHYCYSL | 1392 | 2000.00 | 8 |
| 799 | HPV | 16 | 2 | 2 | B*2705 | QQYNKPLC | 1393 | 100.00 | 8 |
| 800 | HPV | 16 | 2 | 2 | B*5102 | KPLCDLLI | 1394 | 1200.00 | 8 |
| 801 | HPV | 16 | 2 | 2 | B*2705 | IRCINCQK | 1395 | 2000.00 | 8 |
| 802 | HPV | 16 | 2 | 2 | B*2705 | KQRHLDKK | 1396 | 180.00 | 8 |
| 803 | HPV | 16 | 2 | 2 | B*2705 | KQRFHNIR | 1397 | 300.00 | 8 |
| 804 | HPV | 16 | 2 | 2 | B*2705 | IRGRWTGR | 1398 | 1000.00 | 8 |
| 805 | HPV | 16 | 2 | 2 | B*2705 | GRWTGRCM | 1399 | 3000.00 | 8 |
| 806 | HPV | 16 | 2 | 2 | B*2705 | GRCMSCCR | 1400 | 1000.00 | 8 |
| 807 | HPV | 16 | 2 | 2 | B*2705 | CRSSRTRR | 1401 | 300.00 | 8 |
| 808 | HPV | 16 | 2 | 2 | B*2705 | AMFQDPQER | 1516 | 125.00 | 9 |
| 809 | HPV | 16 | 2 | 2 | Cw*0401 | DPQERPRKL | 1517 | 116.16 | 9 |
| 810 | HPV | 16 | 2 | 2 | B*5102 | DPQERPRKL | 1517 | 242.00 | 9 |
| 811 | HPV | 16 | 2 | 2 | B14 | ERPRKLPQL | 1518 | 360.00 | 9 |
| 812 | HPV | 16 | 2 | 2 | B*2705 | ERPRKLPQL | 1518 | 200.00 | 9 |
| 813 | HPV | 16 | 2 | 2 | B*5201 | LQTTIHDII | 1402 | 300.00 | 9 |
| 814 | HPV | 16 | 2 | 2 | B*3901 | IHDIILECV | 1403 | 135.00 | 9 |
| 815 | HPV | 16 | 2 | 2 | B*2705 | QQLLRREVY | 1404 | 100.00 | 9 |
| 816 | HPV | 16 | 2 | 2 | B62 | LLRREVYDF | 1405 | 120.00 | 9 |
| 817 | HPV | 16 | 2 | 2 | B*2705 | LRREVYDFA | 1406 | 200.00 | 9 |
| 818 | HPV | 16 | 2 | 2 | B*2702 | RREVYDFAF | 1407 | 600.00 | 9 |
| 819 | HPV | 16 | 2 | 2 | B*2705 | RREVYDFAF | 1407 | 3000.00 | 9 |
| 820 | HPV | 16 | 2 | 2 | A24 | VYDFAFRDL | 1408 | 240.00 | 9 |
| 821 | HPV | 16 | 2 | 2 | Cw*0401 | VYDFAFRDL | 1408 | 330.00 | 9 |
| 822 | HPV | 16 | 2 | 2 | B*5103 | FAFRDLCIV | 1409 | 132.00 | 9 |
| 823 | HPV | 16 | 2 | 2 | B*5102 | FAFRDLCIV | 1409 | 1100.00 | 9 |
| 824 | HPV | 16 | 2 | 2 | B*2705 | FRDLCIVYR | 1410 | 1000.00 | 9 |
| 825 | HPV | 16 | 2 | 2 | B*2705 | YRDGNPYAV | 1411 | 600.00 | 9 |
| 826 | HPV | 16 | 2 | 2 | B*5102 | NPYAVCDKC | 1412 | 110.00 | 9 |

TABLE 7-continued

| No | Species | Strain type | Frame | ORF | HLA | Seq | Seq ID No. | Score | Length |
|---|---|---|---|---|---|---|---|---|---|
| 827 | HPV | 16 | 2 | 2 | A1 | ISEYRHYCY | 1413 | 135.00 | 9 |
| 828 | HPV | 16 | 2 | 2 | A24 | EYRHYCYSL | 1414 | 200.00 | 9 |
| 829 | HPV | 16 | 2 | 2 | Cw*0401 | EYRHYCYSL | 1414 | 220.00 | 9 |
| 830 | HPV | 16 | 2 | 2 | B*2702 | YRHYCYSLY | 1415 | 200.00 | 9 |
| 831 | HPV | 16 | 2 | 2 | B*2705 | YRHYCYSLY | 1415 | 1000.00 | 9 |
| 832 | HPV | 16 | 2 | 2 | A24 | CYSLYGTTL | 1416 | 200.00 | 9 |
| 833 | HPV | 16 | 2 | 2 | Cw*0401 | CYSLYGTTL | 1416 | 200.00 | 9 |
| 834 | HPV | 16 | 2 | 2 | B60 | LEQQYNKPL | 1417 | 160.00 | 9 |
| 835 | HPV | 16 | 2 | 2 | A24 | QYNKPLCDL | 1418 | 300.00 | 9 |
| 836 | HPV | 16 | 2 | 2 | Cw*0401 | QYNKPLCDL | 1418 | 400.00 | 9 |
| 837 | HPV | 16 | 2 | 2 | Cw*0401 | CPEEKQRHL | 1419 | 105.60 | 9 |
| 838 | HPV | 16 | 2 | 2 | B*2705 | QRHLDKKQR | 1420 | 300.00 | 9 |
| 839 | HPV | 16 | 2 | 2 | B*2705 | QRFHNIRGR | 1421 | 1500.00 | 9 |
| 840 | HPV | 16 | 2 | 2 | B*2705 | IRGRWTGRC | 1422 | 200.00 | 9 |
| 841 | HPV | 16 | 2 | 2 | B*2705 | GRWTGRCMS | 1423 | 1000.00 | 9 |
| 842 | HPV | 16 | 2 | 2 | B*2705 | GRCMSCCRS | 1424 | 200.00 | 9 |
| 843 | HPV | 16 | 2 | 2 | B14 | SRTRRETQL | 1425 | 300.00 | 9 |
| 844 | HPV | 16 | 2 | 2 | B*2705 | SRTRRETQL | 1425 | 2000.00 | 9 |
| 845 | HPV | 16 | 2 | 2 | B*2705 | FQDPQERPRK | 1519 | 200.00 | 10 |
| 846 | HPV | 16 | 2 | 2 | B60 | QERPRKLPQL | 1520 | 176.00 | 10 |
| 847 | HPV | 16 | 2 | 2 | Cw*0301 | RKLPQLCTEL | 1521 | 100.00 | 10 |
| 848 | HPV | 16 | 2 | 2 | B*2705 | LQTTIHDIIL | 1426 | 200.00 | 10 |
| 849 | HPV | 16 | 2 | 2 | B60 | LECVYCKQQL | 1427 | 176.00 | 10 |
| 850 | HPV | 16 | 2 | 2 | A68.1 | CVYCKQQLLR | 1428 | 200.00 | 10 |
| 851 | HPV | 16 | 2 | 2 | B*2705 | KQQLLRREVY | 1429 | 300.00 | 10 |
| 852 | HPV | 16 | 2 | 2 | B*2702 | LRREVYDFAF | 1430 | 200.00 | 10 |
| 853 | HPV | 16 | 2 | 2 | B*2705 | LRREVYDFAF | 1430 | 1000.00 | 10 |
| 854 | HPV | 16 | 2 | 2 | B*2705 | RREVYDFAFR | 1431 | 3000.00 | 10 |
| 855 | HPV | 16 | 2 | 2 | Cw*0301 | EVYDFAFRDL | 1432 | 100.00 | 10 |
| 856 | HPV | 16 | 2 | 2 | B*2705 | YRDGNPYAVC | 1433 | 200.00 | 10 |
| 857 | HPV | 16 | 2 | 2 | B*5102 | NPYAVCDKCL | 1434 | 550.00 | 10 |
| 858 | HPV | 16 | 2 | 2 | B*2705 | SEYRHYCYSL | 1435 | 150.00 | 10 |
| 859 | HPV | 16 | 2 | 2 | B60 | SEYRHYCYSL | 1435 | 320.00 | 10 |
| 860 | HPV | 16 | 2 | 2 | B*2705 | QQYNKPLCDL | 1436 | 1000.00 | 10 |
| 861 | HPV | 16 | 2 | 2 | Cw*0401 | QYNKPLCDLL | 1437 | 200.00 | 10 |
| 862 | HPV | 16 | 2 | 2 | A24 | QYNKPLCDLL | 1437 | 360.00 | 10 |
| 863 | HPV | 16 | 2 | 2 | B*2705 | IRCINCQKPL | 1438 | 600.00 | 10 |
| 864 | HPV | 16 | 2 | 2 | B*2705 | CQKPLCPEEK | 1439 | 200.00 | 10 |
| 865 | HPV | 16 | 2 | 2 | B*2702 | QRHLDKKQRF | 1440 | 200.00 | 10 |
| 866 | HPV | 16 | 2 | 2 | B*2705 | QRHLDKKQRF | 1440 | 1000.00 | 10 |
| 867 | HPV | 16 | 2 | 2 | B*2702 | QRFHNIRGRW | 1441 | 500.00 | 10 |
| 868 | HPV | 16 | 2 | 2 | B*2705 | QRFHNIRGRW | 1441 | 1000.00 | 10 |
| 869 | HPV | 16 | 2 | 2 | B*2705 | IRGRWTGRCM | 1442 | 180.00 | 10 |
| 870 | HPV | 16 | 2 | 2 | B*2702 | GRWTGRCMSC | 1443 | 100.00 | 10 |
| 871 | HPV | 16 | 2 | 2 | B*2705 | GRWTGRCMSC | 1443 | 1000.00 | 10 |
| 872 | HPV | 16 | 2 | 2 | A68.1 | WTGRCMSCCR | 1444 | 100.00 | 10 |
| 873 | HPV | 16 | 2 | 5 | B*2705 | VQLDKQNR | 1522 | 100.00 | 8 |
| 874 | HPV | 16 | 2 | 5 | B*2705 | KQNRTEPI | 1445 | 180.00 | 8 |
| 875 | HPV | 16 | 2 | 5 | B*2705 | NRTEPITI | 1446 | 600.00 | 8 |
| 876 | HPV | 16 | 2 | 5 | A68.1 | MVQLDKQNR | 1523 | 200.00 | 9 |
| 877 | HPV | 16 | 2 | 5 | B*2705 | NRTEPITIL | 1447 | 2000.00 | 9 |
| 878 | HPV | 16 | 2 | 5 | B*2705 | KQNRTEPITI | 1448 | 180.00 | 10 |
| 879 | HPV | 16 | 2 | 6 | B*2705 | VRDVMDGF | 1449 | 1000.00 | 8 |
| 880 | HPV | 16 | 2 | 6 | B*2705 | VRDVMDGFM | 1451 | 600.00 | 9 |
| 881 | HPV | 16 | 2 | 6 | B*2702 | KRVRDVMDGF | 1454 | 600.00 | 10 |
| 882 | HPV | 16 | 2 | 6 | B*2705 | KRVRDVMDGF | 1454 | 3000.00 | 10 |
| 883 | HPV | 16 | 2 | 7 | B*2705 | TRTKMTVI | 1524 | 600.00 | 8 |
| 884 | HPV | 16 | 2 | 7 | B*2705 | KMTVIQVK | 1525 | 150.00 | 8 |
| 885 | HPV | 16 | 2 | 7 | Cw*0401 | LYQMTRTKM | 1526 | 132.00 | 9 |
| 886 | HPV | 16 | 2 | 7 | A*0201 | YQMTRTKMTV | 1527 | 120.02 | 10 |
| 887 | HPV | 16 | 2 | 7 | B*2705 | TRTKMTVIQV | 1528 | 600.00 | 10 |
| 888 | HPV | 16 | 2 | 8 | B*2705 | MRCLLHRK | 1529 | 600.00 | 8 |
| 889 | HPV | 16 | 2 | 8 | B*2705 | HRKQNNIEM | 1455 | 600.00 | 9 |
| 890 | HPV | 16 | 2 | 8 | B*2705 | KQNNIEMQY | 1456 | 300.00 | 9 |
| 891 | HPV | 16 | 2 | 8 | B*2705 | KQNNIEMQYR | 1457 | 300.00 | 10 |
| 892 | HPV | 16 | 2 | 10 | B*5102 | NGCVTISKI | 1530 | 193.60 | 9 |
| 893 | HPV | 16 | 2 | 11 | A68.1 | CVSNVYDDR | 1531 | 200.00 | 9 |
| 894 | HPV | 16 | 2 | 11 | A68.1 | NVYDDRASK | 1532 | 120.00 | 9 |
| 895 | HPV | 16 | 2 | 13 | B*5102 | MPSIINYI | 1533 | 440.00 | 8 |
| 896 | HPV | 16 | 2 | 15 | B*3901 | GHYKTLAL | 1534 | 270.00 | 8 |
| 897 | HPV | 16 | 2 | 16 | B*2705 | IQWKCSLM | 1535 | 300.00 | 8 |
| 898 | HPV | 16 | 2 | 16 | B*5201 | ETYAIQCII | 1536 | 120.00 | 9 |
| 899 | HPV | 16 | 2 | 16 | B*2705 | IQTGHIYIF | 1537 | 100.00 | 9 |
| 900 | HPV | 16 | 2 | 16 | B62 | IQTGHIYIF | 1537 | 124.80 | 9 |
| 901 | HPV | 16 | 2 | 16 | B*2705 | IQWKCSLMET | 1538 | 100.00 | 10 |
| 902 | HPV | 16 | 2 | 17 | A24 | EYEHILCSL | 1539 | 420.00 | 9 |

TABLE 7-continued

| No | Species | Strain type | Frame | ORF | HLA | Seq | Seq ID No. | Score | Length |
|---|---|---|---|---|---|---|---|---|---|
| 903 | HPV | 16 | 2 | 17 | Cw*0401 | EYEHILCSL | 1539 | 440.00 | 9 |
| 904 | HPV | 16 | 2 | 17 | A3 | KMMQKNIVK | 1540 | 180.00 | 9 |
| 905 | HPV | 16 | 2 | 17 | B*2705 | KMMQKNIVK | 1540 | 150.00 | 9 |
| 906 | HPV | 16 | 2 | 17 | Cw*0401 | MFMKEYEHIL | 1541 | 200.00 | 10 |
| 907 | HPV | 16 | 2 | 17 | B*2705 | KEYEHILCSL | 1542 | 450.00 | 10 |
| 908 | HPV | 16 | 2 | 17 | B60 | KEYEHILCSL | 1542 | 176.00 | 10 |
| 909 | HPV | 16 | 2 | 17 | A*0201 | KMMQKNIVKI | 1543 | 224.42 | 10 |
| 910 | HPV | 16 | 2 | 17 | B*2705 | MQKNIVKIKY | 1544 | 100.00 | 10 |
| 911 | HPV | 16 | 2 | 17 | B62 | MQKNIVKIKY | 1544 | 288.00 | 10 |
| 912 | HPV | 16 | 2 | 18 | B*2705 | TNFCLKLK | 1545 | 100.00 | 8 |
| 913 | HPV | 16 | 2 | 18 | B*2705 | YQKLLQCL | 1546 | 200.00 | 8 |
| 914 | HPV | 16 | 2 | 18 | B8 | CLKLKYQKL | 1547 | 160.00 | 9 |
| 915 | HPV | 16 | 2 | 18 | A24 | KYQKLLQCL | 1548 | 864.00 | 9 |
| 916 | HPV | 16 | 2 | 18 | Cw*0401 | KYQKLLQCL | 1548 | 400.00 | 9 |
| 917 | HPV | 16 | 2 | 18 | B*2705 | YQKLLQCLL | 1549 | 200.00 | 9 |
| 918 | HPV | 16 | 2 | 18 | A*0201 | KLLQCLLDL | 1550 | 636.28 | 9 |
| 919 | HPV | 16 | 2 | 18 | A*0205 | KLLQCLLDL | 1550 | 126.00 | 9 |
| 920 | HPV | 16 | 2 | 18 | B*2705 | LQCLLDLCL | 1551 | 200.00 | 9 |
| 921 | HPV | 16 | 2 | 18 | A68.1 | NVTNFCLKLK | 1552 | 120.00 | 10 |
| 922 | HPV | 16 | 2 | 18 | Cw*0301 | FCLKLKYQKL | 1553 | 120.00 | 10 |
| 923 | HPV | 16 | 2 | 18 | Cw*0401 | KYQKLLQCLL | 1554 | 200.00 | 10 |
| 924 | HPV | 16 | 2 | 18 | A24 | KYQKLLQCLL | 1554 | 720.00 | 10 |
| 925 | HPV | 16 | 2 | 18 | B*2705 | LQCLLDLCLY | 1555 | 100.00 | 10 |
| 926 | HPV | 16 | 2 | 18 | A3 | CLLDLCLYDK | 1556 | 135.00 | 10 |
| 927 | HPV | 16 | 2 | 19 | B*2705 | MRHKRSAK | 1557 | 2000.00 | 8 |
| 928 | HPV | 16 | 2 | 19 | B*2705 | KRSAKRTK | 1558 | 6000.00 | 8 |
| 929 | HPV | 16 | 2 | 19 | B*2705 | KRTKRASA | 1559 | 600.00 | 8 |
| 930 | HPV | 16 | 2 | 19 | B*2705 | KRASATQL | 1560 | 6000.00 | 8 |
| 931 | HPV | 16 | 2 | 19 | B*2705 | TQLYKTCK | 1561 | 200.00 | 8 |
| 932 | HPV | 16 | 2 | 19 | B*2705 | LQYGSMGV | 1562 | 300.00 | 8 |
| 933 | HPV | 16 | 2 | 19 | B*2705 | GRTGYIPL | 1563 | 2000.00 | 8 |
| 934 | HPV | 16 | 2 | 19 | B*5102 | GPSDPSIV | 1564 | 200.00 | 8 |
| 935 | HPV | 16 | 2 | 19 | B*5102 | DPSIVSLV | 1565 | 220.00 | 8 |
| 936 | HPV | 16 | 2 | 19 | B*5102 | DAGAPTSV | 1566 | 110.00 | 8 |
| 937 | HPV | 16 | 2 | 19 | B*5102 | APTSVPSI | 1567 | 440.00 | 8 |
| 938 | HPV | 16 | 2 | 19 | B*5102 | VPSIPPDV | 1568 | 200.00 | 8 |
| 939 | HPV | 16 | 2 | 19 | B*5102 | IPMDTFIV | 1569 | 220.00 | 8 |
| 940 | HPV | 16 | 2 | 19 | B*5102 | RPVARLGL | 1570 | 300.00 | 8 |
| 941 | HPV | 16 | 2 | 19 | B*2705 | ARLGLYSR | 1571 | 1000.00 | 8 |
| 942 | HPV | 16 | 2 | 19 | B*2705 | SRTTQQVK | 1572 | 2000.00 | 8 |
| 943 | HPV | 16 | 2 | 19 | B*5102 | DPDFLDIV | 1573 | 100.00 | 8 |
| 944 | HPV | 16 | 2 | 19 | B*5102 | VALHRPAL | 1574 | 165.00 | 8 |
| 945 | HPV | 16 | 2 | 19 | B*2705 | HRPALTSR | 1575 | 1000.00 | 8 |
| 946 | HPV | 16 | 2 | 19 | B*2705 | SRRTGIRY | 1576 | 300.00 | 8 |
| 947 | HPV | 16 | 2 | 19 | B*2705 | RRTGIRYS | 1577 | 600.00 | 8 |
| 948 | HPV | 16 | 2 | 19 | B*5102 | TGIRYSRI | 1578 | 290.40 | 8 |
| 949 | HPV | 16 | 2 | 19 | B*2705 | IRYSRIGN | 1579 | 1000.00 | 8 |
| 950 | HPV | 16 | 2 | 19 | B*2705 | SRIGNKQT | 1580 | 200.00 | 8 |
| 951 | HPV | 16 | 2 | 19 | B*5102 | DPAEEIEL | 1581 | 133.10 | 8 |
| 952 | HPV | 16 | 2 | 19 | B*5102 | HAASPTSI | 1582 | 220.00 | 8 |
| 953 | HPV | 16 | 2 | 19 | B*5102 | GAYNIPLV | 1583 | 550.00 | 8 |
| 954 | HPV | 16 | 2 | 19 | B*5102 | GPDIPINI | 1584 | 220.00 | 8 |
| 955 | HPV | 16 | 2 | 19 | B*5102 | QAPSLIPI | 1585 | 220.00 | 8 |
| 956 | HPV | 16 | 2 | 19 | B*5102 | APSLIPIV | 1586 | 220.00 | 8 |
| 957 | HPV | 16 | 2 | 19 | B*2705 | LRKRRKRL | 1587 | 600.00 | 8 |
| 958 | HPV | 16 | 2 | 19 | B*2705 | KRRKRLPY | 1588 | 3000.00 | 8 |
| 959 | HPV | 16 | 2 | 19 | B*2705 | RRKRLPYF | 1589 | 3000.00 | 8 |
| 960 | HPV | 16 | 2 | 19 | B*2705 | KRLPYFFS | 1590 | 600.00 | 8 |
| 961 | HPV | 16 | 2 | 19 | B*5102 | LPYFFSDV | 1591 | 1000.00 | 8 |
| 962 | HPV | 16 | 2 | 19 | B*2705 | MRHKRSAKR | 1592 | 1000.00 | 9 |
| 963 | HPV | 16 | 2 | 19 | B*2705 | KRSAKRTKR | 1593 | 3000.00 | 9 |
| 964 | HPV | 16 | 2 | 19 | B*2705 | KRTKRASAT | 1594 | 600.00 | 9 |
| 965 | HPV | 16 | 2 | 19 | B*2702 | KRASATQLY | 1595 | 600.00 | 9 |
| 966 | HPV | 16 | 2 | 19 | B*2705 | KRASATQLY | 1595 | 3000.00 | 9 |
| 967 | HPV | 16 | 2 | 19 | B*5103 | QAGTCPPDI | 1596 | 110.00 | 9 |
| 968 | HPV | 16 | 2 | 19 | B*5102 | QAGTCPPDI | 1596 | 220.00 | 9 |
| 969 | HPV | 16 | 2 | 19 | B*5102 | CPPDIIPKV | 1597 | 440.00 | 9 |
| 970 | HPV | 16 | 2 | 19 | B*5102 | IPKVEGKTI | 1598 | 242.00 | 9 |
| 971 | HPV | 16 | 2 | 19 | A*0201 | ILQYGSMGV | 1599 | 118.24 | 9 |
| 972 | HPV | 16 | 2 | 19 | B*2702 | LQYGSMGVF | 1600 | 100.00 | 9 |
| 973 | HPV | 16 | 2 | 19 | B*2705 | LQYGSMGVF | 1600 | 500.00 | 9 |
| 974 | HPV | 16 | 2 | 19 | B*5201 | LQYGSMGVF | 1600 | 375.00 | 9 |
| 975 | HPV | 16 | 2 | 19 | B62 | LQYGSMGVF | 1600 | 105.60 | 9 |
| 976 | HPV | 16 | 2 | 19 | A24 | QYGSMGVFF | 1601 | 100.00 | 9 |
| 977 | HPV | 16 | 2 | 19 | Cw*0401 | QYGSMGVFF | 1601 | 110.00 | 9 |
| 978 | HPV | 16 | 2 | 19 | A68.1 | GTGSGTGGR | 1602 | 100.00 | 9 |

TABLE 7-continued

| No | Species | Strain type | Frame | ORF | HLA | Seq | Seq ID No. | Score | Length |
|---|---|---|---|---|---|---|---|---|---|
| 979 | HPV | 16 | 2 | 19 | B*2705 | TRPPTATDT | 1603 | 200.00 | 9 |
| 980 | HPV | 16 | 2 | 19 | B*5102 | RPPTATDTL | 1604 | 133.10 | 9 |
| 981 | HPV | 16 | 2 | 19 | B*5103 | TATDTLAPV | 1605 | 110.00 | 9 |
| 982 | HPV | 16 | 2 | 19 | B*5102 | TATDTLAPV | 1605 | 110.00 | 9 |
| 983 | HPV | 16 | 2 | 19 | B*5102 | APVRPPLTV | 1606 | 726.00 | 9 |
| 984 | HPV | 16 | 2 | 19 | B*5102 | RPPLTVDPV | 1607 | 242.00 | 9 |
| 985 | HPV | 16 | 2 | 19 | B*5201 | VGPSDPSIV | 1608 | 150.00 | 9 |
| 986 | HPV | 16 | 2 | 19 | A*0201 | SLVEETSFI | 1609 | 235.26 | 9 |
| 987 | HPV | 16 | 2 | 19 | B*5103 | GAPTSVPSI | 1610 | 110.00 | 9 |
| 988 | HPV | 16 | 2 | 19 | B*5102 | GAPTSVPSI | 1610 | 220.00 | 9 |
| 989 | HPV | 16 | 2 | 19 | A*0201 | AILDINNTV | 1611 | 145.08 | 9 |
| 990 | HPV | 16 | 2 | 19 | B*5102 | NPTFTDPSV | 1612 | 220.00 | 9 |
| 991 | HPV | 16 | 2 | 19 | B60 | AETGGHFTL | 1613 | 160.00 | 9 |
| 992 | HPV | 16 | 2 | 19 | B*5102 | TPIPGSRPV | 1614 | 726.00 | 9 |
| 993 | HPV | 16 | 2 | 19 | B14 | SRPVARLGL | 1615 | 200.00 | 9 |
| 994 | HPV | 16 | 2 | 19 | B*2705 | SRPVARLGL | 1615 | 2000.00 | 9 |
| 995 | HPV | 16 | 2 | 19 | B*2705 | ARLGLYSRT | 1616 | 200.00 | 9 |
| 996 | HPV | 16 | 2 | 19 | B*2705 | SRTTQQVKV | 1617 | 600.00 | 9 |
| 997 | HPV | 16 | 2 | 19 | Cw*0401 | AFVTTPTKL | 1618 | 264.00 | 9 |
| 998 | HPV | 16 | 2 | 19 | B*5102 | NPAYEGIDV | 1619 | 200.00 | 9 |
| 999 | HPV | 16 | 2 | 19 | B*5102 | APDPDFLDI | 1620 | 200.00 | 9 |
| 1000 | HPV | 16 | 2 | 19 | B*2705 | HRPALTSRR | 1621 | 1000.00 | 9 |
| 1001 | HPV | 16 | 2 | 19 | B*2705 | RRTGIRYSR | 1622 | 3000.00 | 9 |
| 1002 | HPV | 16 | 2 | 19 | B*2705 | IRYSRIGNK | 1623 | 10000.00 | 9 |
| 1003 | HPV | 16 | 2 | 19 | B*2705 | SRIGNKQTL | 1624 | 2000.00 | 9 |
| 1004 | HPV | 16 | 2 | 19 | B*2705 | LRTRSGKSI | 1625 | 180.00 | 9 |
| 1005 | HPV | 16 | 2 | 19 | B*2705 | TRSGKSIGA | 1626 | 200.00 | 9 |
| 1006 | HPV | 16 | 2 | 19 | Cw*0301 | AKVHYYYDL | 1627 | 100.00 | 9 |
| 1007 | HPV | 16 | 2 | 19 | B*2705 | LQTITPSTY | 1628 | 100.00 | 9 |
| 1008 | HPV | 16 | 2 | 19 | B*5102 | SPTSINNGL | 1629 | 110.00 | 9 |
| 1009 | HPV | 16 | 2 | 19 | A24 | LYDIYADDF | 1630 | 100.00 | 9 |
| 1010 | HPV | 16 | 2 | 19 | Cw*0401 | LYDIYADDF | 1630 | 150.00 | 9 |
| 1011 | HPV | 16 | 2 | 19 | B*3701 | YDIYADDFI | 1631 | 200.00 | 9 |
| 1012 | HPV | 16 | 2 | 19 | B7 | VPSVPSTSL | 1632 | 120.00 | 9 |
| 1013 | HPV | 16 | 2 | 19 | B*5102 | VPSVPSTSL | 1632 | 100.00 | 9 |
| 1014 | HPV | 16 | 2 | 19 | B*5102 | IPFGGAYNI | 1633 | 2420.00 | 9 |
| 1015 | HPV | 16 | 2 | 19 | B*5102 | IPLVSGPDI | 1634 | 1200.00 | 9 |
| 1016 | HPV | 16 | 2 | 19 | B*5103 | QAPSLIPIV | 1635 | 110.00 | 9 |
| 1017 | HPV | 16 | 2 | 19 | B*5102 | QAPSLIPIV | 1635 | 110.00 | 9 |
| 1018 | HPV | 16 | 2 | 19 | B*5102 | VPGSPQYTI | 1636 | 484.00 | 9 |
| 1019 | HPV | 16 | 2 | 19 | Cw*0401 | FYLHPSYYM | 1637 | 100.00 | 9 |
| 1020 | HPV | 16 | 2 | 19 | A*0201 | YLHPSYYML | 1638 | 147.40 | 9 |
| 1021 | HPV | 16 | 2 | 19 | B8 | MLRKRRKRL | 1639 | 160.00 | 9 |
| 1022 | HPV | 16 | 2 | 19 | B*2702 | KRRKRLPYF | 1640 | 600.00 | 9 |
| 1023 | HPV | 16 | 2 | 19 | B*2705 | KRRKRLPYF | 1640 | 3000.00 | 9 |
| 1024 | HPV | 16 | 2 | 19 | B*2702 | RRKRLPYFF | 1641 | 600.00 | 9 |
| 1025 | HPV | 16 | 2 | 19 | B*2705 | RRKRLPYFF | 1641 | 3000.00 | 9 |
| 1026 | HPV | 16 | 2 | 19 | A*0201 | RLPYFFSDV | 1642 | 502.17 | 9 |
| 1027 | HPV | 16 | 2 | 19 | B*2705 | KRSAKRTKRA | 1643 | 180.00 | 10 |
| 1028 | HPV | 16 | 2 | 19 | B*2705 | KRASATQLYK | 1644 | 6000.00 | 10 |
| 1029 | HPV | 16 | 2 | 19 | B*2705 | KQAGTCPPDI | 1645 | 180.00 | 10 |
| 1030 | HPV | 16 | 2 | 19 | B*5102 | QAGTCPPDII | 1646 | 220.00 | 10 |
| 1031 | HPV | 16 | 2 | 19 | B*5103 | QAGTCPPDII | 1646 | 110.00 | 10 |
| 1032 | HPV | 16 | 2 | 19 | B*2702 | LQYGSMGVFF | 1647 | 100.00 | 10 |
| 1033 | HPV | 16 | 2 | 19 | B*2705 | LQYGSMGVFF | 1647 | 500.00 | 10 |
| 1034 | HPV | 16 | 2 | 19 | B*5201 | LQYGSMGVFF | 1647 | 168.75 | 10 |
| 1035 | HPV | 16 | 2 | 19 | B62 | LQYGSMGVFF | 1647 | 115.20 | 10 |
| 1036 | HPV | 16 | 2 | 19 | Cw*0301 | GSMGVFFGGL | 1648 | 100.00 | 10 |
| 1037 | HPV | 16 | 2 | 19 | B*5102 | MGVFFGGLGI | 1649 | 264.00 | 10 |
| 1038 | HPV | 16 | 2 | 19 | B*5102 | SGTGGRTGYI | 1650 | 106.48 | 10 |
| 1039 | HPV | 16 | 2 | 19 | B*2705 | GRTGYIPLGT | 1651 | 200.00 | 10 |
| 1040 | HPV | 16 | 2 | 19 | A68.1 | RTGYIPLGTR | 1652 | 100.00 | 10 |
| 1041 | HPV | 16 | 2 | 19 | B*2705 | TRPPTATDTL | 1653 | 2000.00 | 10 |
| 1042 | HPV | 16 | 2 | 19 | B*5102 | LAPVRPPLTV | 1654 | 110.00 | 10 |
| 1043 | HPV | 16 | 2 | 19 | B*5103 | LAPVRPPLTV | 1654 | 110.00 | 10 |
| 1044 | HPV | 16 | 2 | 19 | B*2705 | VRPPLTVDPV | 1655 | 600.00 | 10 |
| 1045 | HPV | 16 | 2 | 19 | B*5102 | DPVGPSDPSI | 1656 | 1320.00 | 10 |
| 1046 | HPV | 16 | 2 | 19 | B*5102 | GPSDPSIVSL | 1657 | 110.00 | 10 |
| 1047 | HPV | 16 | 2 | 19 | Cw*0401 | GPSDPSIVSL | 1657 | 211.20 | 10 |
| 1048 | HPV | 16 | 2 | 19 | B*5102 | IPPDVSGFSI | 1658 | 400.00 | 10 |
| 1049 | HPV | 16 | 2 | 19 | B*5102 | NPTFTDPSVL | 1659 | 100.00 | 10 |
| 1050 | HPV | 16 | 2 | 19 | Cw*0401 | NYEEIPMDTF | 1660 | 144.00 | 10 |
| 1051 | HPV | 16 | 2 | 19 | A24 | NYEEIPMDTF | 1660 | 180.00 | 10 |
| 1052 | HPV | 16 | 2 | 19 | B7 | IPGSRPVARL | 1661 | 120.00 | 10 |
| 1053 | HPV | 16 | 2 | 19 | B*5102 | IPGSRPVARL | 1661 | 200.00 | 10 |
| 1054 | HPV | 16 | 2 | 19 | Cw*0401 | IPGSRPVARL | 1661 | 192.00 | 10 |

TABLE 7-continued

| No | Species | Strain type | Frame | ORF | HLA | Seq | Seq ID No. | Score | Length |
|---|---|---|---|---|---|---|---|---|---|
| 1055 | HPV | 16 | 2 | 19 | B*2702 | SRPVARLGLY | 1662 | 200.00 | 10 |
| 1056 | HPV | 16 | 2 | 19 | B*2705 | SRPVARLGLY | 1662 | 1000.00 | 10 |
| 1057 | HPV | 16 | 2 | 19 | A*0201 | GLYSRTTQQV | 1663 | 222.57 | 10 |
| 1058 | HPV | 16 | 2 | 19 | B*2705 | SRTTQQVKVV | 1664 | 180.00 | 10 |
| 1059 | HPV | 16 | 2 | 19 | B*2705 | QQVKVVDPAF | 1665 | 100.00 | 10 |
| 1060 | HPV | 16 | 2 | 19 | B60 | YEGIDVDNTL | 1666 | 176.00 | 10 |
| 1061 | HPV | 16 | 2 | 19 | B*5102 | IAPDPDFLDI | 1667 | 200.00 | 10 |
| 1062 | HPV | 16 | 2 | 19 | B*5103 | IAPDPDFLDI | 1667 | 100.00 | 10 |
| 1063 | HPV | 16 | 2 | 19 | B*5102 | APDPDFLDIV | 1668 | 100.00 | 10 |
| 1064 | HPV | 16 | 2 | 19 | B*5201 | APDPDFLDIV | 1668 | 198.00 | 10 |
| 1065 | HPV | 16 | 2 | 19 | Cw*0401 | DPDFLDIVAL | 1669 | 240.00 | 10 |
| 1066 | HPV | 16 | 2 | 19 | B14 | DIVALHRPAL | 1670 | 135.00 | 10 |
| 1067 | HPV | 16 | 2 | 19 | B*2705 | SRRTGIRYSR | 1671 | 1000.00 | 10 |
| 1068 | HPV | 16 | 2 | 19 | B*2702 | RRTGIRYSRI | 1672 | 180.00 | 10 |
| 1069 | HPV | 16 | 2 | 19 | B*2705 | RRTGIRYSRI | 1672 | 1800.00 | 10 |
| 1070 | HPV | 16 | 2 | 19 | B*2705 | IRYSRIGNKQ | 1673 | 100.00 | 10 |
| 1071 | HPV | 16 | 2 | 19 | B*2705 | SRIGNKQTLR | 1674 | 1000.00 | 10 |
| 1072 | HPV | 16 | 2 | 19 | B*2705 | KQTLRTRSGK | 1675 | 600.00 | 10 |
| 1073 | HPV | 16 | 2 | 19 | B*2705 | TRSGKSIGAK | 1676 | 2000.00 | 10 |
| 1074 | HPV | 16 | 2 | 19 | A*0201 | TRSGKSIGAK | 1676 | 180.37 | 10 |
| 1075 | HPV | 16 | 2 | 19 | B*5102 | VPSTSLSGYI | 1677 | 484.00 | 10 |
| 1076 | HPV | 16 | 2 | 19 | B*5102 | SGYIPANTTI | 1678 | 484.00 | 10 |
| 1077 | HPV | 16 | 2 | 19 | B*5103 | SGYIPANTTI | 1678 | 132.00 | 10 |
| 1078 | HPV | 16 | 2 | 19 | B*5201 | DQAPSLIPIV | 1679 | 240.00 | 10 |
| 1079 | HPV | 16 | 2 | 19 | B*5102 | VPGSPQYTII | 1680 | 440.00 | 10 |
| 1080 | HPV | 16 | 2 | 19 | A*0201 | IIADAGDFYL | 1681 | 653.09 | 10 |
| 1081 | HPV | 16 | 2 | 19 | Cw*0401 | DFYLHPSYYM | 1682 | 100.00 | 10 |
| 1082 | HPV | 16 | 2 | 19 | Cw*0301 | FYLHPSYYML | 1683 | 100.00 | 10 |
| 1083 | HPV | 16 | 2 | 19 | Cw*0401 | FYLHPSYYML | 1683 | 200.00 | 10 |
| 1084 | HPV | 16 | 2 | 19 | A24 | FYLHPSYYML | 1683 | 300.00 | 10 |
| 1085 | HPV | 16 | 2 | 19 | A*0201 | YMLRKRRKRL | 1684 | 262.59 | 10 |
| 1086 | HPV | 16 | 2 | 19 | B14 | YMLRKRRKRL | 1684 | 250.00 | 10 |
| 1087 | HPV | 16 | 2 | 19 | B*2702 | LRKRRKRLPY | 1685 | 200.00 | 10 |
| 1088 | HPV | 16 | 2 | 19 | B*2705 | LRKRRKRLPY | 1685 | 1000.00 | 10 |
| 1089 | HPV | 16 | 2 | 19 | B*2702 | KRRKRLPYFF | 1686 | 600.00 | 10 |
| 1090 | HPV | 16 | 2 | 19 | B*2705 | KRRKRLPYFF | 1686 | 3000.00 | 10 |
| 1091 | HPV | 16 | 2 | 19 | B*2705 | RRKRLPYFFS | 1687 | 600.00 | 10 |
| 1092 | HPV | 16 | 2 | 19 | B*2705 | KRLPYFFSDV | 1688 | 1800.00 | 10 |
| 1093 | HPV | 16 | 2 | 19 | B*5102 | LPYFFSDVSL | 1689 | 500.00 | 10 |
| 1094 | HPV | 16 | 2 | 20 | B*5102 | YGLQTNTI | 1690 | 638.88 | 8 |
| 1095 | HPV | 16 | 2 | 20 | B*2705 | LQTNTIVF | 1691 | 100.00 | 8 |
| 1096 | HPV | 16 | 2 | 20 | B*2705 | YRGTLGQR | 1692 | 1000.00 | 8 |
| 1097 | HPV | 16 | 2 | 20 | B*5102 | RGTLGQRI | 1693 | 117.13 | 8 |
| 1098 | HPV | 16 | 2 | 20 | B*2705 | QRIPMYQC | 1503 | 200.00 | 8 |
| 1099 | HPV | 16 | 2 | 20 | B*2705 | YQCCSKSR | 1504 | 100.00 | 8 |
| 1100 | HPV | 16 | 2 | 20 | B*5201 | YGLQTNTIV | 1694 | 165.00 | 9 |
| 1101 | HPV | 16 | 2 | 20 | B*5102 | YGLQTNTIV | 1694 | 319.44 | 9 |
| 1102 | HPV | 16 | 2 | 20 | B*5801 | QTNTIVFNW | 1695 | 158.40 | 9 |
| 1103 | HPV | 16 | 2 | 20 | B*2705 | LQTTYRGTL | 1696 | 200.00 | 9 |
| 1104 | HPV | 16 | 2 | 20 | B*2705 | YRGTLGQRI | 1697 | 600.00 | 9 |
| 1105 | HPV | 16 | 2 | 20 | B*2705 | QRIPMYQCC | 1505 | 200.00 | 9 |
| 1106 | HPV | 16 | 2 | 20 | B*2705 | QRIPMYQCCS | 1506 | 200.00 | 10 |
| 1107 | HPV | 16 | 2 | 22 | B*2705 | MRAKSLFS | 1510 | 200.00 | 8 |
| 1108 | HPV | 16 | 2 | 23 | B*2705 | MRQRLTYR | 1698 | 1000.00 | 8 |
| 1109 | HPV | 16 | 2 | 23 | B*2705 | MRQRLTYRC | 1699 | 200.00 | 9 |
| 1110 | HPV | 16 | 3 | 1 | B*2705 | LQCFRTHR | 1700 | 100.00 | 8 |
| 1111 | HPV | 16 | 3 | 1 | B*2705 | HRSDPESY | 1701 | 1000.00 | 8 |
| 1112 | HPV | 16 | 3 | 1 | B*5102 | YAQSCKQL | 1702 | 110.00 | 8 |
| 1113 | HPV | 16 | 3 | 1 | B*2705 | AQSCKQLY | 1703 | 100.00 | 8 |
| 1114 | HPV | 16 | 3 | 1 | B*2705 | HRSDPESYH | 1704 | 200.00 | 9 |
| 1115 | HPV | 16 | 3 | 1 | A24 | SYAQSCKQL | 1705 | 200.00 | 9 |
| 1116 | HPV | 16 | 3 | 1 | Cw*0401 | SYAQSCKQL | 1705 | 200.00 | 9 |
| 1117 | HPV | 16 | 3 | 1 | B*2705 | FRTHRSDPES | 1706 | 200.00 | 10 |
| 1118 | HPV | 16 | 3 | 1 | B*2705 | HRSDPESYHS | 1707 | 200.00 | 10 |
| 1119 | HPV | 16 | 3 | 1 | A1 | RSDPESYHSY | 1708 | 375.00 | 10 |
| 1120 | HPV | 16 | 3 | 4 | B*2705 | LRSTAAAL | 1709 | 2000.00 | 8 |
| 1121 | HPV | 16 | 3 | 4 | B*2705 | QRQTVLQH | 1710 | 200.00 | 8 |
| 1122 | HPV | 16 | 3 | 4 | B*2705 | SQMVQWAY | 1711 | 100.00 | 8 |
| 1123 | HPV | 16 | 3 | 4 | B*5102 | WAYDNDIV | 1712 | 550.00 | 8 |
| 1124 | HPV | 16 | 3 | 4 | B*5102 | IAYKYAQL | 1713 | 302.50 | 8 |
| 1125 | HPV | 16 | 3 | 4 | B*2705 | KRAEKKQM | 1714 | 1800.00 | 8 |
| 1126 | HPV | 16 | 3 | 4 | B*2705 | KQIVMFLR | 1715 | 300.00 | 8 |
| 1127 | HPV | 16 | 3 | 4 | B*2705 | LRYQGVEF | 1716 | 5000.00 | 8 |
| 1128 | HPV | 16 | 3 | 4 | B*2705 | KRFLQGIP | 1717 | 300.00 | 8 |
| 1129 | HPV | 16 | 3 | 4 | B*2705 | LQGSVICF | 1718 | 100.00 | 8 |
| 1130 | HPV | 16 | 3 | 4 | B*3901 | SHFWLQPL | 1719 | 180.00 | 8 |

TABLE 7-continued

| No | Species | Strain type | Frame | ORF | HLA | Seq | Seq ID No. | Score | Length |
|---|---|---|---|---|---|---|---|---|---|
| 1131 | HPV | 16 | 3 | 4 | B*2705 | LQPLADAK | 1720 | 200.00 | 8 |
| 1132 | HPV | 16 | 3 | 4 | B*5102 | QPLADAKI | 1721 | 1320.00 | 8 |
| 1133 | HPV | 16 | 3 | 4 | B*2705 | WNYIDDNL | 1722 | 100.00 | 8 |
| 1134 | HPV | 16 | 3 | 4 | B*2705 | LRNALDGN | 1723 | 200.00 | 8 |
| 1135 | HPV | 16 | 3 | 4 | B*5102 | NALDGNLV | 1724 | 363.00 | 8 |
| 1136 | HPV | 16 | 3 | 4 | B*2705 | HRPLVQLK | 1725 | 2000.00 | 8 |
| 1137 | HPV | 16 | 3 | 4 | B*2705 | VQLKCPPL | 1726 | 200.00 | 8 |
| 1138 | HPV | 16 | 3 | 4 | B*2705 | SRWPYLHN | 1727 | 1000.00 | 8 |
| 1139 | HPV | 16 | 3 | 4 | B*5102 | WPYLHNRL | 1728 | 665.50 | 8 |
| 1140 | HPV | 16 | 3 | 4 | B*2705 | NRLVVFTF | 1729 | 1000.00 | 8 |
| 1141 | HPV | 16 | 3 | 4 | B*2705 | SRTWSRLS | 1730 | 200.00 | 8 |
| 1142 | HPV | 16 | 3 | 4 | B*2705 | RTWSRLSL | 1731 | 150.00 | 8 |
| 1143 | HPV | 16 | 3 | 4 | B*2702 | LRSTAAALY | 1732 | 200.00 | 9 |
| 1144 | HPV | 16 | 3 | 4 | B*2705 | LRSTAAALY | 1732 | 1000.00 | 9 |
| 1145 | HPV | 16 | 3 | 4 | B*5801 | RSTAAALYW | 1733 | 264.00 | 9 |
| 1146 | HPV | 16 | 3 | 4 | B*5102 | TGISNISEV | 1734 | 145.20 | 9 |
| 1147 | HPV | 16 | 3 | 4 | B*2705 | QRQTVLQHS | 1735 | 200.00 | 9 |
| 1148 | HPV | 16 | 3 | 4 | B*2705 | RQTVLQHSF | 1736 | 300.00 | 9 |
| 1149 | HPV | 16 | 3 | 4 | B62 | RQTVLQHSF | 1736 | 160.00 | 9 |
| 1150 | HPV | 16 | 3 | 4 | Cw*0401 | SFNDCTFEL | 1737 | 240.00 | 9 |
| 1151 | HPV | 16 | 3 | 4 | B*2705 | VQWAYDNDI | 1738 | 300.00 | 9 |
| 1152 | HPV | 16 | 3 | 4 | A1 | IVDDSEIAY | 1739 | 125.00 | 9 |
| 1153 | HPV | 16 | 3 | 4 | A68.1 | ATMCRHYKR | 1740 | 100.00 | 9 |
| 1154 | HPV | 16 | 3 | 4 | B*2705 | CRHYKRAEK | 1741 | 2000.00 | 9 |
| 1155 | HPV | 16 | 3 | 4 | B*2705 | KRAEKKQMS | 1742 | 600.00 | 9 |
| 1156 | HPV | 16 | 3 | 4 | B*2705 | KQMSMSQWI | 1743 | 180.00 | 9 |
| 1157 | HPV | 16 | 3 | 4 | A68.1 | RVDDGGDWK | 1744 | 120.00 | 9 |
| 1158 | HPV | 16 | 3 | 4 | B*2705 | KQIVMFLRY | 1745 | 300.00 | 9 |
| 1159 | HPV | 16 | 3 | 4 | A*0201 | VMFLRYQGV | 1746 | 473.94 | 9 |
| 1160 | HPV | 16 | 3 | 4 | B62 | FLRYQGVEF | 1747 | 144.00 | 9 |
| 1161 | HPV | 16 | 3 | 4 | B*2702 | LRYQGVEFM | 1748 | 100.00 | 9 |
| 1162 | HPV | 16 | 3 | 4 | B*2705 | LRYQGVEFM | 1748 | 3000.00 | 9 |
| 1163 | HPV | 16 | 3 | 4 | B*2705 | YQGVEFMSF | 1749 | 100.00 | 9 |
| 1164 | HPV | 16 | 3 | 4 | B62 | YQGVEFMSF | 1749 | 160.00 | 9 |
| 1165 | HPV | 16 | 3 | 4 | Cw*0401 | EFMSFLTAL | 1750 | 400.00 | 9 |
| 1166 | HPV | 16 | 3 | 4 | Cw*0401 | SFLTALKRF | 1751 | 220.00 | 9 |
| 1167 | HPV | 16 | 3 | 4 | A*0201 | FLTALKRFL | 1752 | 108.09 | 9 |
| 1168 | HPV | 16 | 3 | 4 | B*2705 | KRFLQGIPK | 1753 | 30000.00 | 9 |
| 1169 | HPV | 16 | 3 | 4 | B*5102 | QGIPKKNCI | 1754 | 240.00 | 9 |
| 1170 | HPV | 16 | 3 | 4 | A3 | SLFGMSLMK | 1755 | 300.00 | 9 |
| 1171 | HPV | 16 | 3 | 4 | B*2705 | SLFGMSLMK | 1755 | 150.00 | 9 |
| 1172 | HPV | 16 | 3 | 4 | Cw*0401 | LFGMSLMKF | 1756 | 220.00 | 9 |
| 1173 | HPV | 16 | 3 | 4 | A*0201 | LQGSVICFV | 1757 | 151.65 | 9 |
| 1174 | HPV | 16 | 3 | 4 | A68.1 | SVICFVNSK | 1758 | 240.00 | 9 |
| 1175 | HPV | 16 | 3 | 4 | Cw*0401 | CFVNSKSHF | 1759 | 110.00 | 9 |
| 1176 | HPV | 16 | 3 | 4 | B*2705 | LRNALDGNL | 1760 | 2000.00 | 9 |
| 1177 | HPV | 16 | 3 | 4 | A68.1 | LVSMDVKHR | 1761 | 300.00 | 9 |
| 1178 | HPV | 16 | 3 | 4 | B*2705 | HRPLVQLKC | 1762 | 200.00 | 9 |
| 1179 | HPV | 16 | 3 | 4 | B*2705 | VQLKCPPLL | 1763 | 200.00 | 9 |
| 1180 | HPV | 16 | 3 | 4 | B*5102 | PPLLITSNI | 1764 | 145.20 | 9 |
| 1181 | HPV | 16 | 3 | 4 | B*2705 | SRWPYLHNR | 1765 | 5000.00 | 9 |
| 1182 | HPV | 16 | 3 | 4 | B*5103 | WPYLHNRLV | 1766 | 132.00 | 9 |
| 1183 | HPV | 16 | 3 | 4 | B*5102 | WPYLHNRLV | 1766 | 1331.00 | 9 |
| 1184 | HPV | 16 | 3 | 4 | B*2705 | KNWKSFFSR | 1767 | 150.00 | 9 |
| 1185 | HPV | 16 | 3 | 4 | Cw*0401 | FFSRTWSRL | 1768 | 240.00 | 9 |
| 1186 | HPV | 16 | 3 | 4 | B14 | SRTWSRLSL | 1769 | 100.00 | 9 |
| 1187 | HPV | 16 | 3 | 4 | B*2705 | SRTWSRLSL | 1769 | 2000.00 | 9 |
| 1188 | HPV | 16 | 3 | 4 | B62 | KLRSTAAALY | 1770 | 120.00 | 10 |
| 1189 | HPV | 16 | 3 | 4 | B*2702 | LRSTAAALYW | 1771 | 100.00 | 10 |
| 1190 | HPV | 16 | 3 | 4 | B*2705 | LRSTAAALYW | 1771 | 200.00 | 10 |
| 1191 | HPV | 16 | 3 | 4 | B*5102 | AALYWKTGI | 1772 | 600.00 | 10 |
| 1192 | HPV | 16 | 3 | 4 | B*5103 | AALYWKTGI | 1772 | 132.00 | 10 |
| 1193 | HPV | 16 | 3 | 4 | B*5102 | TPEWIQRQTV | 1773 | 133.10 | 10 |
| 1194 | HPV | 16 | 3 | 4 | B*2702 | QRQTVLQHSF | 1774 | 200.00 | 10 |
| 1195 | HPV | 16 | 3 | 4 | B*2705 | QRQTVLQHSF | 1774 | 1000.00 | 10 |
| 1196 | HPV | 16 | 3 | 4 | B*2705 | LQHSFNDCTF | 1775 | 100.00 | 10 |
| 1197 | HPV | 16 | 3 | 4 | B*2705 | VQWAYDNDIV | 1776 | 300.00 | 10 |
| 1198 | HPV | 16 | 3 | 4 | B*5201 | VQWAYDNDIV | 1776 | 990.00 | 10 |
| 1199 | HPV | 16 | 3 | 4 | A68.1 | IVDDSEIAYK | 1777 | 120.00 | 10 |
| 1200 | HPV | 16 | 3 | 4 | B60 | SEIAYKYAQL | 1778 | 352.00 | 10 |
| 1201 | HPV | 16 | 3 | 4 | Cw*0301 | SEIAYKYAQL | 1778 | 100.00 | 10 |
| 1202 | HPV | 16 | 3 | 4 | A68.1 | IVKDCATMCR | 1779 | 200.00 | 10 |
| 1203 | HPV | 16 | 3 | 4 | B*2705 | CRHYKRAEKK | 1780 | 2000.00 | 10 |
| 1204 | HPV | 16 | 3 | 4 | Cw*0401 | HYKRAEKKQM | 1781 | 100.00 | 10 |
| 1205 | HPV | 16 | 3 | 4 | B*2705 | KRAEKKQMSM | 1782 | 1800.00 | 10 |
| 1206 | HPV | 16 | 3 | 4 | B*2705 | KQMSMSQWIK | 1783 | 600.00 | 10 |

TABLE 7-continued

| No | Species | Strain type | Frame | ORF | HLA | Seq | Seq ID No. | Score | Length |
|---|---|---|---|---|---|---|---|---|---|
| 1207 | HPV | 16 | 3 | 4 | B*2705 | SQWIKYRCDR | 1784 | 500.00 | 10 |
| 1208 | HPV | 16 | 3 | 4 | B*2705 | DRVDDGGDWK | 1785 | 200.00 | 10 |
| 1209 | HPV | 16 | 3 | 4 | B*3701 | GDWKQIVMFL | 1786 | 300.00 | 10 |
| 1210 | HPV | 16 | 3 | 4 | Cw*0401 | MFLRYQGVEF | 1787 | 100.00 | 10 |
| 1211 | HPV | 16 | 3 | 4 | B*2705 | LRYQGVEFMS | 1788 | 1000.00 | 10 |
| 1212 | HPV | 16 | 3 | 4 | Cw*0401 | RYQGVEFMSF | 1789 | 110.00 | 10 |
| 1213 | HPV | 16 | 3 | 4 | A24 | RYQGVEFMSF | 1789 | 360.00 | 10 |
| 1214 | HPV | 16 | 3 | 4 | A*0201 | YQGVEFMSFL | 1790 | 478.93 | 10 |
| 1215 | HPV | 16 | 3 | 4 | B*2705 | YQGVEFMSFL | 1790 | 200.00 | 10 |
| 1216 | HPV | 16 | 3 | 4 | B*2705 | VEFMSFLTAL | 1791 | 150.00 | 10 |
| 1217 | HPV | 16 | 3 | 4 | B60 | VEFMSFLTAL | 1791 | 160.00 | 10 |
| 1218 | HPV | 16 | 3 | 4 | Cw*0401 | SFLTALKRFL | 1792 | 200.00 | 10 |
| 1219 | HPV | 16 | 3 | 4 | B*5102 | TALKRFLQGI | 1793 | 726.00 | 10 |
| 1220 | HPV | 16 | 3 | 4 | B*5103 | TALKRFLQGI | 1793 | 132.00 | 10 |
| 1221 | HPV | 16 | 3 | 4 | B*2705 | KRFLQGIPKK | 1794 | 30000.00 | 10 |
| 1222 | HPV | 16 | 3 | 4 | Cw*0301 | QGIPKKNCIL | 1795 | 100.00 | 10 |
| 1223 | HPV | 16 | 3 | 4 | B*3501 | IPKKNCILLY | 1796 | 120.00 | 10 |
| 1224 | HPV | 16 | 3 | 4 | A3 | LLYGAANTGK | 1797 | 150.00 | 10 |
| 1225 | HPV | 16 | 3 | 4 | B*2705 | LLYGAANTGK | 1797 | 150.00 | 10 |
| 1226 | HPV | 16 | 3 | 4 | Cw*0401 | LFGMSLMKFL | 1798 | 240.00 | 10 |
| 1227 | HPV | 16 | 3 | 4 | Cw*0401 | KFLQGSVICF | 1799 | 200.00 | 10 |
| 1228 | HPV | 16 | 3 | 4 | A*0201 | FLQGSVICFV | 1800 | 4047.23 | 10 |
| 1229 | HPV | 16 | 3 | 4 | A*0201 | FVNSKSHFWL | 1801 | 274.29 | 10 |
| 1230 | HPV | 16 | 3 | 4 | B*5102 | DATVPCWNYI | 1802 | 220.00 | 10 |
| 1231 | HPV | 16 | 3 | 4 | B*5103 | DATVPCWNYI | 1802 | 121.00 | 10 |
| 1232 | HPV | 16 | 3 | 4 | B*2705 | LRNALDGNLV | 1803 | 600.00 | 10 |
| 1233 | HPV | 16 | 3 | 4 | B*5102 | CPPLLITSNI | 1804 | 484.00 | 10 |
| 1234 | HPV | 16 | 3 | 4 | B*2702 | SRWPYLHNRL | 1805 | 300.00 | 10 |
| 1235 | HPV | 16 | 3 | 4 | B*2705 | SRWPYLHNRL | 1805 | 10000.00 | 10 |
| 1236 | HPV | 16 | 3 | 4 | B*5102 | WPYLHNRLVV | 1806 | 1210.00 | 10 |
| 1237 | HPV | 16 | 3 | 4 | B*5103 | WPYLHNRLVV | 1806 | 145.20 | 10 |
| 1238 | HPV | 16 | 3 | 4 | B*5201 | WPYLHNRLVV | 1806 | 300.00 | 10 |
| 1239 | HPV | 16 | 3 | 4 | A*0201 | YLHNRLVVFT | 1807 | 433.63 | 10 |
| 1240 | HPV | 16 | 3 | 4 | B*2705 | NRLVVFTFPN | 1808 | 200.00 | 10 |
| 1241 | HPV | 16 | 3 | 4 | Cw*0401 | VFTFPNEFPF | 1809 | 100.00 | 10 |
| 1242 | HPV | 16 | 3 | 4 | B*5102 | FPFDENGNPV | 1810 | 2200.00 | 10 |
| 1243 | HPV | 16 | 3 | 4 | B60 | DENGNPVYEL | 1811 | 320.00 | 10 |
| 1244 | HPV | 16 | 3 | 4 | Cw*0401 | SFFSRTWSRL | 1812 | 240.00 | 10 |
| 1245 | HPV | 16 | 3 | 4 | B*2705 | SRTWSRLSLH | 1813 | 200.00 | 10 |
| 1246 | HPV | 16 | 3 | 5 | B*5103 | LACFLLCFV | 1814 | 100.00 | 9 |
| 1247 | HPV | 16 | 3 | 5 | B*5102 | LACFLLCFV | 1814 | 100.00 | 9 |
| 1248 | HPV | 16 | 3 | 5 | Cw*0401 | CFLLCFVCF | 1815 | 100.00 | 9 |
| 1249 | HPV | 16 | 3 | 5 | A*0201 | FLLCFVCFC | 1816 | 4064.58 | 9 |
| 1250 | HPV | 16 | 3 | 5 | A*0201 | LLCFVCFCV | 1817 | 685.78 | 9 |
| 1251 | HPV | 16 | 3 | 5 | A*0201 | FLLCFVCFCV | 1818 | 6865.90 | 10 |
| 1252 | HPV | 16 | 3 | 6 | B*2705 | LRLGVLLY | 1819 | 1000.00 | 8 |
| 1253 | HPV | 16 | 3 | 6 | B*2705 | LRLGVLLYI | 1820 | 600.00 | 9 |
| 1254 | HPV | 16 | 3 | 6 | A*0205 | GVLLYILYL | 1821 | 100.80 | 9 |
| 1255 | HPV | 16 | 3 | 6 | A*0201 | LLYILYLFI | 1822 | 468.22 | 9 |
| 1256 | HPV | 16 | 3 | 6 | A3 | ILYLFIYHY | 1823 | 270.00 | 9 |
| 1257 | HPV | 16 | 3 | 6 | B62 | ILYLFIYHY | 1823 | 104.00 | 9 |
| 1258 | HPV | 16 | 3 | 6 | A24 | LYLFIYHYF | 1824 | 210.00 | 9 |
| 1259 | HPV | 16 | 3 | 6 | Cw*0401 | LYLFIYHYF | 1824 | 100.00 | 9 |
| 1260 | HPV | 16 | 3 | 6 | B14 | LRLGVLLYIL | 1825 | 300.00 | 10 |
| 1261 | HPV | 16 | 3 | 6 | B*2705 | LRLGVLLYIL | 1825 | 2000.00 | 10 |
| 1262 | HPV | 16 | 3 | 6 | B62 | RLGVLLYILY | 1826 | 192.00 | 10 |
| 1263 | HPV | 16 | 3 | 6 | A*0201 | VLLYILYLFI | 1827 | 541.38 | 10 |
| 1264 | HPV | 16 | 3 | 6 | A3 | LLYILYLFIY | 1828 | 270.00 | 10 |
| 1265 | HPV | 16 | 3 | 6 | B62 | ILYLFIYHYF | 1829 | 114.40 | 10 |
| 1266 | HPV | 16 | 3 | 7 | B*2705 | HRLPNFIK | 1830 | 2000.00 | 8 |
| 1267 | HPV | 16 | 3 | 7 | B*5102 | HANRQVHV | 1831 | 121.00 | 8 |
| 1268 | HPV | 16 | 3 | 7 | B*2705 | NRQVHVHL | 1832 | 2000.00 | 8 |
| 1269 | HPV | 16 | 3 | 7 | B8 | YLRLKAKL | 1833 | 160.00 | 8 |
| 1270 | HPV | 16 | 3 | 7 | B*2705 | LRLKAKLL | 1834 | 2000.00 | 8 |
| 1271 | HPV | 16 | 3 | 7 | B*2705 | LQNAQNVHR | 1835 | 100.00 | 9 |
| 1272 | HPV | 16 | 3 | 7 | B*2705 | HRLPNFIKH | 1836 | 200.00 | 9 |
| 1273 | HPV | 16 | 3 | 7 | B7 | ANRQVHVHL | 1837 | 120.00 | 9 |
| 1274 | HPV | 16 | 3 | 7 | B*2705 | NRQVHVHLT | 1838 | 200.00 | 9 |
| 1275 | HPV | 16 | 3 | 7 | B*2705 | RQVHVHLTL | 1839 | 600.00 | 9 |
| 1276 | HPV | 16 | 3 | 7 | B*3901 | VHVHLTLYL | 1840 | 180.00 | 9 |
| 1277 | HPV | 16 | 3 | 7 | A68.1 | HVHLTLYLR | 1841 | 200.00 | 9 |
| 1278 | HPV | 16 | 3 | 7 | B*3901 | VHLTLYLRL | 1842 | 180.00 | 9 |
| 1279 | HPV | 16 | 3 | 7 | Cw*0301 | VHLTLYLRL | 1842 | 100.00 | 9 |
| 1280 | HPV | 16 | 3 | 7 | A24 | LYLRLKAKL | 1843 | 396.00 | 9 |
| 1281 | HPV | 16 | 3 | 7 | Cw*0401 | LYLRLKAKL | 1843 | 264.00 | 9 |
| 1282 | HPV | 16 | 3 | 7 | B8 | YLRLKAKLL | 1844 | 160.00 | 9 |

TABLE 7-continued

| No | Species | Strain type | Frame | ORF | HLA | Seq | Seq ID No. | Score | Length |
|---|---|---|---|---|---|---|---|---|---|
| 1283 | HPV | 16 | 3 | 7 | B14 | LRLKAKLLL | 1845 | 100.00 | 9 |
| 1284 | HPV | 16 | 3 | 7 | B*2705 | LRLKAKLLL | 1845 | 2000.00 | 9 |
| 1285 | HPV | 16 | 3 | 7 | B*2705 | LQNAQNVHRL | 1846 | 200.00 | 10 |
| 1286 | HPV | 16 | 3 | 7 | B*2705 | AQNVHRLPNF | 1847 | 100.00 | 10 |
| 1287 | HPV | 16 | 3 | 7 | A68.1 | NVHRLPNFIK | 1848 | 120.00 | 10 |
| 1288 | HPV | 16 | 3 | 7 | B*2705 | NRQVHVHLTL | 1849 | 2000.00 | 10 |
| 1289 | HPV | 16 | 3 | 7 | B*2705 | RQVHVHLTLY | 1850 | 300.00 | 10 |
| 1290 | HPV | 16 | 3 | 7 | B*2705 | TLYLRLKAKL | 1851 | 150.00 | 10 |
| 1291 | HPV | 16 | 3 | 7 | Cw*0401 | LYLRLKAKLL | 1852 | 200.00 | 10 |
| 1292 | HPV | 16 | 3 | 7 | A24 | LYLRLKAKLL | 1852 | 300.00 | 10 |
| 1293 | HPV | 16 | 3 | 7 | B*2705 | LRLKAKLLLN | 1853 | 200.00 | 10 |
| 1294 | HPV | 16 | 3 | 7 | A*0201 | LLNKYYNMEV | 1854 | 118.24 | 10 |
| 1295 | HPV | 16 | 3 | 7 | Cw*0401 | YYNMEVWVYF | 1855 | 100.00 | 10 |
| 1296 | HPV | 16 | 3 | 7 | A24 | YYNMEVWVYF | 1855 | 210.00 | 10 |
| 1297 | HPV | 16 | 3 | 7 | A*0201 | YNMEVWVYPL | 1856 | 123.10 | 10 |
| 1298 | HPV | 16 | 3 | 8 | B*5102 | QGLPQLQI | 1857 | 290.40 | 8 |
| 1299 | HPV | 16 | 3 | 8 | B*5102 | LPQLQIHL | 1858 | 133.10 | 8 |
| 1300 | HPV | 16 | 3 | 8 | Cw*0401 | LPQLQIHLL | 1859 | 160.00 | 9 |
| 1301 | HPV | 16 | 3 | 8 | B*5102 | LPQLQIHLL | 1859 | 133.10 | 9 |
| 1302 | HPV | 16 | 3 | 8 | B*3901 | FHWEQGLPQL | 1860 | 540.00 | 10 |
| 1303 | HPV | 16 | 3 | 8 | Cw*0301 | QGLPQLQIHL | 1861 | 100.00 | 10 |
| 1304 | HPV | 16 | 3 | 8 | B*5102 | LPQLQIHLLL | 1862 | 110.00 | 10 |
| 1305 | HPV | 16 | 3 | 10 | B*2705 | HQHLYLPF | 1863 | 100.00 | 8 |
| 1306 | HPV | 16 | 3 | 10 | B*5102 | FPQMYQDL | 1864 | 220.00 | 8 |
| 1307 | HPV | 16 | 3 | 10 | B*2705 | QMYQDLVL | 1865 | 250.00 | 8 |
| 1308 | HPV | 16 | 3 | 10 | B*2705 | YQDLVLLL | 1866 | 200.00 | 8 |
| 1309 | HPV | 16 | 3 | 10 | B*2705 | LQLIPHLL | 1867 | 200.00 | 8 |
| 1310 | HPV | 16 | 3 | 10 | B*5102 | FPQMYQDLV | 1868 | 440.00 | 9 |
| 1311 | HPV | 16 | 3 | 10 | A*0201 | QMYQDLVLL | 1869 | 113.55 | 9 |
| 1312 | HPV | 16 | 3 | 10 | B*2705 | QMYQDLVLL | 1869 | 250.00 | 9 |
| 1313 | HPV | 16 | 3 | 10 | A24 | MYQDLVLLL | 1870 | 432.00 | 9 |
| 1314 | HPV | 16 | 3 | 10 | Cw*0401 | MYQDLVLLL | 1870 | 480.00 | 9 |
| 1315 | HPV | 16 | 3 | 10 | A*0201 | LLLQLIPHL | 1871 | 309.05 | 9 |
| 1316 | HPV | 16 | 3 | 10 | B*2705 | LQLIPHLLY | 1872 | 100.00 | 9 |
| 1317 | HPV | 16 | 3 | 10 | B*5102 | LPFPQMYQDL | 1873 | 550.00 | 10 |
| 1318 | HPV | 16 | 3 | 10 | Cw*0301 | LPFPQMYQDL | 1873 | 180.00 | 10 |
| 1319 | HPV | 16 | 3 | 10 | Cw*0401 | LPFPQMYQDL | 1873 | 105.60 | 10 |
| 1320 | HPV | 16 | 3 | 10 | B*5102 | FPQMYQDLVL | 1874 | 220.00 | 10 |
| 1321 | HPV | 16 | 3 | 10 | A*0201 | QMYQDLVLLL | 1875 | 113.55 | 10 |
| 1322 | HPV | 16 | 3 | 10 | B*2705 | QMYQDLVLLL | 1875 | 250.00 | 10 |
| 1323 | HPV | 16 | 3 | 10 | B*2705 | YQDLVLLLQL | 1876 | 200.00 | 10 |
| 1324 | HPV | 16 | 3 | 10 | B*3701 | QDLVLLLQLI | 1877 | 200.00 | 10 |
| 1325 | HPV | 16 | 3 | 10 | A*0201 | VLLLQLIPHL | 1878 | 309.05 | 10 |
| 1326 | HPV | 16 | 3 | 10 | A*0201 | LLLQLIPHLL | 1879 | 134.37 | 10 |
| 1327 | HPV | 16 | 3 | 11 | B*5102 | IPLSLTHL | 1880 | 330.00 | 8 |
| 1328 | HPV | 16 | 3 | 11 | B*2705 | LQKLEGIL | 1881 | 200.00 | 8 |
| 1329 | HPV | 16 | 3 | 11 | B*3901 | LHFHHPLL | 1882 | 180.00 | 8 |
| 1330 | HPV | 16 | 3 | 11 | B*5102 | HPLLVHII | 1883 | 1452.00 | 8 |
| 1331 | HPV | 16 | 3 | 11 | B*2705 | FLWIHLLL | 1884 | 150.00 | 8 |
| 1332 | HPV | 16 | 3 | 11 | A*0201 | LLLHIIIPL | 1885 | 309.05 | 9 |
| 1333 | HPV | 16 | 3 | 11 | B*3901 | LHIIIPLSL | 1886 | 180.00 | 9 |
| 1334 | HPV | 16 | 3 | 11 | B*2705 | HLYCSLQHL | 1887 | 150.00 | 9 |
| 1335 | HPV | 16 | 3 | 11 | B*5102 | HPLLVHIIM | 1888 | 108.90 | 9 |
| 1336 | HPV | 16 | 3 | 11 | A3 | LLVHIIMKK | 1889 | 135.00 | 9 |
| 1337 | HPV | 16 | 3 | 11 | Cw*0401 | KFLWIHLLL | 1890 | 200.00 | 9 |
| 1338 | HPV | 16 | 3 | 11 | A*0201 | FLWIHLLLA | 1891 | 436.26 | 9 |
| 1339 | HPV | 16 | 3 | 11 | B*3901 | IHLLLAQTL | 1892 | 180.00 | 9 |
| 1340 | HPV | 16 | 3 | 11 | A*0201 | LLLLHIIIPL | 1893 | 309.05 | 10 |
| 1341 | HPV | 16 | 3 | 11 | Cw*0301 | IIIPLSLTHL | 1894 | 100.00 | 10 |
| 1342 | HPV | 16 | 3 | 11 | Cw*0301 | LSLTHLYCSL | 1895 | 100.00 | 10 |
| 1343 | HPV | 16 | 3 | 11 | B*3901 | THLYCSLQHL | 1896 | 270.00 | 10 |
| 1344 | HPV | 16 | 3 | 11 | B*2705 | LQKLEGILHF | 1897 | 100.00 | 10 |
| 1345 | HPV | 16 | 3 | 11 | B62 | LQKLEGILHF | 1897 | 576.00 | 10 |
| 1346 | HPV | 16 | 3 | 11 | A*0201 | ILHFHHPLLV | 1898 | 118.24 | 10 |
| 1347 | HPV | 16 | 3 | 12 | B*5102 | LALGTVEL | 1899 | 199.65 | 8 |
| 1348 | HPV | 16 | 3 | 12 | B*5103 | LALGTVELV | 1900 | 132.00 | 9 |
| 1349 | HPV | 16 | 3 | 12 | B*5102 | LALGTVELV | 1900 | 399.30 | 9 |
| 1350 | HPV | 16 | 3 | 12 | A24 | HYVLVVENL | 1901 | 420.00 | 9 |
| 1351 | HPV | 16 | 3 | 12 | Cw*0401 | HYVLVVENL | 1901 | 400.00 | 9 |
| 1352 | HPV | 16 | 3 | 12 | B*5102 | LALGTVELVI | 1902 | 726.00 | 10 |
| 1353 | HPV | 16 | 3 | 12 | B*5103 | LALGTVELVI | 1902 | 145.20 | 10 |
| 1354 | HPV | 16 | 3 | 12 | B*3901 | KHYVLVVENL | 1903 | 270.00 | 10 |
| 1355 | HPV | 16 | 3 | 13 | B*5102 | YPLHLYQV | 1904 | 1452.00 | 8 |
| 1356 | HPV | 16 | 3 | 13 | B*2705 | HLYQVIFL | 1905 | 150.00 | 8 |
| 1357 | HPV | 16 | 3 | 13 | B*2705 | LQIQQFLL | 1906 | 200.00 | 8 |
| 1358 | HPV | 16 | 3 | 13 | B*2705 | QQFLLVVH | 1907 | 100.00 | 8 |

TABLE 7-continued

| No | Species | Strain type | Frame | ORF | HLA | Seq | Seq ID No. | Score | Length |
|---|---|---|---|---|---|---|---|---|---|
| 1359 | HPV | 16 | 3 | 13 | B*5201 | YPLHLYQVI | 1908 | 220.00 | 9 |
| 1360 | HPV | 16 | 3 | 13 | B*5102 | YPLHLYQVI | 1908 | 2904.00 | 9 |
| 1361 | HPV | 16 | 3 | 13 | B*3901 | LHLYQVIFL | 1909 | 270.00 | 9 |
| 1362 | HPV | 16 | 3 | 13 | A24 | LYQVIFLQI | 1910 | 126.00 | 9 |
| 1363 | HPV | 16 | 3 | 13 | Cw*0401 | IFLQIQQFL | 1911 | 200.00 | 9 |
| 1364 | HPV | 16 | 3 | 13 | A*0201 | FLQIQQFLL | 1912 | 569.95 | 9 |
| 1365 | HPV | 16 | 3 | 13 | B*2705 | QQFLLVVHT | 1913 | 100.00 | 9 |
| 1366 | HPV | 16 | 3 | 13 | A*0201 | LLVVHTIFL | 1914 | 199.74 | 9 |
| 1367 | HPV | 16 | 3 | 13 | A24 | LYPLHLYQVI | 1915 | 108.00 | 10 |
| 1368 | HPV | 16 | 3 | 13 | A*0201 | VIFLQIQQFL | 1916 | 101.62 | 10 |
| 1369 | HPV | 16 | 3 | 13 | Cw*0401 | IFLQIQQFLL | 1917 | 200.00 | 10 |
| 1370 | HPV | 16 | 3 | 13 | A*0201 | FLQIQQFLLV | 1918 | 607.88 | 10 |
| 1371 | HPV | 16 | 3 | 13 | B*5201 | LQIQQFLLVV | 1919 | 495.00 | 10 |
| 1372 | HPV | 16 | 3 | 13 | B*2705 | QQFLLVVHTI | 1920 | 300.00 | 10 |
| 1373 | HPV | 16 | 3 | 13 | B*5201 | QQFLLVVHTI | 1920 | 120.00 | 10 |
| 1374 | HPV | 16 | 3 | 13 | Cw*0401 | QFLLVVHTIF | 1921 | 100.00 | 10 |
| 1375 | HPV | 16 | 3 | 13 | A*0201 | FLLVVHTIFL | 1922 | 1999.73 | 10 |
| 1376 | HPV | 16 | 3 | 14 | B*2705 | ARTNIYYH | 1923 | 200.00 | 8 |
| 1377 | HPV | 16 | 3 | 14 | B*2705 | SRLLAVGH | 1924 | 200.00 | 8 |
| 1378 | HPV | 16 | 3 | 14 | B*5102 | KPNNNKIL | 1925 | 121.00 | 8 |
| 1379 | HPV | 16 | 3 | 14 | B*5201 | LQYRVFRI | 1926 | 150.00 | 8 |
| 1380 | HPV | 16 | 3 | 14 | B*2705 | YRVFRIHL | 1927 | 2000.00 | 8 |
| 1381 | HPV | 16 | 3 | 14 | B*5102 | NPDTQRLV | 1928 | 121.00 | 8 |
| 1382 | HPV | 16 | 3 | 14 | B*2705 | QRLVWACV | 1929 | 600.00 | 8 |
| 1383 | HPV | 16 | 3 | 14 | B*5102 | WACVGVEV | 1930 | 121.00 | 8 |
| 1384 | HPV | 16 | 3 | 14 | B*2705 | GRGQPLGV | 1931 | 600.00 | 8 |
| 1385 | HPV | 16 | 3 | 14 | B*2705 | KQTQLCLI | 1932 | 180.00 | 8 |
| 1386 | HPV | 16 | 3 | 14 | B*5102 | SPCTNVAV | 1933 | 242.00 | 8 |
| 1387 | HPV | 16 | 3 | 14 | B*5102 | NPGDCPPL | 1934 | 100.00 | 8 |
| 1388 | HPV | 16 | 3 | 14 | B*5102 | YPDYIKMV | 1935 | 200.00 | 8 |
| 1389 | HPV | 16 | 3 | 14 | B*2705 | LRREQMFV | 1936 | 600.00 | 8 |
| 1390 | HPV | 16 | 3 | 14 | B*2705 | RREQMFVR | 1937 | 3000.00 | 8 |
| 1391 | HPV | 16 | 3 | 14 | B*2705 | QMFVRHLF | 1938 | 125.00 | 8 |
| 1392 | HPV | 16 | 3 | 14 | B*2705 | AQIFNKPY | 1939 | 100.00 | 8 |
| 1393 | HPV | 16 | 3 | 14 | B*2705 | QRAQGHNN | 1940 | 200.00 | 8 |
| 1394 | HPV | 16 | 3 | 14 | B*2705 | TRSTNMSL | 1941 | 2000.00 | 8 |
| 1395 | HPV | 16 | 3 | 14 | B*3901 | RHGEEYDL | 1942 | 180.00 | 8 |
| 1396 | HPV | 16 | 3 | 14 | B*2705 | LQFIFQLC | 1943 | 100.00 | 8 |
| 1397 | HPV | 16 | 3 | 14 | B*2705 | FQLCKITL | 1944 | 200.00 | 8 |
| 1398 | HPV | 16 | 3 | 14 | B*5102 | TADVMTYI | 1945 | 110.00 | 8 |
| 1399 | HPV | 16 | 3 | 14 | B*5102 | QPPPGGTL | 1946 | 110.00 | 8 |
| 1400 | HPV | 16 | 3 | 14 | B*2705 | YRFVTQAI | 1947 | 3000.00 | 8 |
| 1401 | HPV | 16 | 3 | 14 | B*2705 | TQAIACQK | 1948 | 200.00 | 8 |
| 1402 | HPV | 16 | 3 | 14 | B*3501 | APKEDDPL | 1949 | 180.00 | 8 |
| 1403 | HPV | 16 | 3 | 14 | B*5102 | FPLGRKFL | 1950 | 660.00 | 8 |
| 1404 | HPV | 16 | 3 | 14 | B*2705 | GRKFLLQA | 1951 | 200.00 | 8 |
| 1405 | HPV | 16 | 3 | 14 | B*2705 | LQAGLKAK | 1952 | 200.00 | 8 |
| 1406 | HPV | 16 | 3 | 14 | B8 | KAKPKFTL | 1953 | 160.00 | 8 |
| 1407 | HPV | 16 | 3 | 14 | B*2705 | KRKATPTT | 1954 | 600.00 | 8 |
| 1408 | HPV | 16 | 3 | 14 | A*0201 | LMQVTFIYI | 1955 | 133.86 | 9 |
| 1409 | HPV | 16 | 3 | 14 | B*2705 | MQVTFIYIL | 1956 | 200.00 | 9 |
| 1410 | HPV | 16 | 3 | 14 | B*3901 | YHIFFQMSL | 1957 | 180.00 | 9 |
| 1411 | HPV | 16 | 3 | 14 | Cw*0401 | IFFQMSLWL | 1958 | 220.00 | 9 |
| 1412 | HPV | 16 | 3 | 14 | Cw*0401 | LPSEATVYL | 1959 | 105.60 | 9 |
| 1413 | HPV | 16 | 3 | 14 | B*5102 | LPSEATVYL | 1959 | 133.10 | 9 |
| 1414 | HPV | 16 | 3 | 14 | B*5103 | EATVYLPPV | 1960 | 110.00 | 9 |
| 1415 | HPV | 16 | 3 | 14 | B*5102 | EATVYLPPV | 1960 | 100.00 | 9 |
| 1416 | HPV | 16 | 3 | 14 | B*5102 | LPPVPVSKV | 1961 | 400.00 | 9 |
| 1417 | HPV | 16 | 3 | 14 | B*2705 | ARTNIYYHA | 1962 | 200.00 | 9 |
| 1418 | HPV | 16 | 3 | 14 | A24 | YYHAGTSRL | 1963 | 200.00 | 9 |
| 1419 | HPV | 16 | 3 | 14 | Cw*0401 | YYHAGTSRL | 1963 | 300.00 | 9 |
| 1420 | HPV | 16 | 3 | 14 | B*5102 | KPNNNKILV | 1964 | 242.00 | 9 |
| 1421 | HPV | 16 | 3 | 14 | Cw*0301 | ILVPKVSGL | 1965 | 120.00 | 9 |
| 1422 | HPV | 16 | 3 | 14 | B*3501 | VPKVSGLQY | 1966 | 120.00 | 9 |
| 1423 | HPV | 16 | 3 | 14 | A*0201 | GLQYRVFRI | 1967 | 139.17 | 9 |
| 1424 | HPV | 16 | 3 | 14 | A24 | QYRVFRIHL | 1968 | 200.00 | 9 |
| 1425 | HPV | 16 | 3 | 14 | Cw*0401 | QYRVFRIHL | 1968 | 220.00 | 9 |
| 1426 | HPV | 16 | 3 | 14 | B*2705 | FRIHLPDPN | 1969 | 200.00 | 9 |
| 1427 | HPV | 16 | 3 | 14 | Cw*0401 | KFGPPDTSF | 1970 | 110.00 | 9 |
| 1428 | HPV | 16 | 3 | 14 | A24 | FYNPDTQRL | 1971 | 432.00 | 9 |
| 1429 | HPV | 16 | 3 | 14 | Cw*0401 | FYNPDTQRL | 1971 | 240.00 | 9 |
| 1430 | HPV | 16 | 3 | 14 | B60 | VEVGRGQPL | 1972 | 320.00 | 9 |
| 1431 | HPV | 16 | 3 | 14 | B*5103 | SAYAANAGV | 1973 | 330.00 | 9 |
| 1432 | HPV | 16 | 3 | 14 | B*5102 | SAYAANAGV | 1973 | 550.00 | 9 |
| 1433 | HPV | 16 | 3 | 14 | B*5102 | AGVDNRECI | 1974 | 290.40 | 9 |
| 1434 | HPV | 16 | 3 | 14 | B*2702 | NRECISMDY | 1975 | 200.00 | 9 |

TABLE 7-continued

| No | Species | Strain type | Frame | ORF | HLA | Seq | Seq ID No. | Score | Length |
|---|---|---|---|---|---|---|---|---|---|
| 1435 | HPV | 16 | 3 | 14 | B*2705 | NRECISMDY | 1975 | 1000.00 | 9 |
| 1436 | HPV | 16 | 3 | 14 | A24 | DYKQTQLCL | 1976 | 200.00 | 9 |
| 1437 | HPV | 16 | 3 | 14 | Cw*0401 | DYKQTQLCL | 1976 | 240.00 | 9 |
| 1438 | HPV | 16 | 3 | 14 | B*2705 | TQLCLIGCK | 1977 | 200.00 | 9 |
| 1439 | HPV | 16 | 3 | 14 | B*3701 | GDCPPLELI | 1978 | 200.00 | 9 |
| 1440 | HPV | 16 | 3 | 14 | B*5102 | VPLDICTSI | 1979 | 1200.00 | 9 |
| 1441 | HPV | 16 | 3 | 14 | Cw*0301 | CKYPDYIKM | 1980 | 125.00 | 9 |
| 1442 | HPV | 16 | 3 | 14 | Cw*0401 | FFYLRREQM | 1981 | 110.00 | 9 |
| 1443 | HPV | 16 | 3 | 14 | A24 | FYLRREQMF | 1982 | 180.00 | 9 |
| 1444 | HPV | 16 | 3 | 14 | Cw*0401 | FYLRREQMF | 1982 | 110.00 | 9 |
| 1445 | HPV | 16 | 3 | 14 | A*0201 | YLRREQMFV | 1983 | 133.73 | 9 |
| 1446 | HPV | 16 | 3 | 14 | B*2705 | LRREQMFVR | 1984 | 1000.00 | 9 |
| 1447 | HPV | 16 | 3 | 14 | B*2705 | RREQMFVRH | 1985 | 600.00 | 9 |
| 1448 | HPV | 16 | 3 | 14 | B60 | REQMFVRHL | 1986 | 160.00 | 9 |
| 1449 | HPV | 16 | 3 | 14 | B*2705 | NRAGTVGEN | 1987 | 200.00 | 9 |
| 1450 | HPV | 16 | 3 | 14 | B*5103 | RAGTVGENV | 1988 | 121.00 | 9 |
| 1451 | HPV | 16 | 3 | 14 | B*5102 | RAGTVGENV | 1988 | 133.10 | 9 |
| 1452 | HPV | 16 | 3 | 14 | A68.1 | NVPDDLYIK | 1989 | 120.00 | 9 |
| 1453 | HPV | 16 | 3 | 14 | Cw*0401 | YFPTPSGSM | 1990 | 110.00 | 9 |
| 1454 | HPV | 16 | 3 | 14 | B*5102 | FPTPSGSMV | 1991 | 400.00 | 9 |
| 1455 | HPV | 16 | 3 | 14 | B*5103 | RAQGHNNGI | 1992 | 110.00 | 9 |
| 1456 | HPV | 16 | 3 | 14 | B*5102 | RAQGHNNGI | 1992 | 242.00 | 9 |
| 1457 | HPV | 16 | 3 | 14 | A68.1 | FVTVVDTTR | 1993 | 300.00 | 9 |
| 1458 | HPV | 16 | 3 | 14 | B*2705 | TRSTNMSLC | 1994 | 200.00 | 9 |
| 1459 | HPV | 16 | 3 | 14 | B*2705 | LRHGEEYDL | 1995 | 2000.00 | 9 |
| 1460 | HPV | 16 | 3 | 14 | B*2705 | LQFIFQLCK | 1996 | 1000.00 | 9 |
| 1461 | HPV | 16 | 3 | 14 | Cw*0401 | IFQLCKITL | 1997 | 200.00 | 9 |
| 1462 | HPV | 16 | 3 | 14 | B*2705 | LQPPPGGTL | 1998 | 200.00 | 9 |
| 1463 | HPV | 16 | 3 | 14 | B*2702 | YRFVTQAIA | 1999 | 100.00 | 9 |
| 1464 | HPV | 16 | 3 | 14 | B*2705 | YRFVTQAIA | 1999 | 1000.00 | 9 |
| 1465 | HPV | 16 | 3 | 14 | A24 | KYTFWEVNL | 2000 | 400.00 | 9 |
| 1466 | HPV | 16 | 3 | 14 | Cw*0401 | KYTFWEVNL | 2000 | 200.00 | 9 |
| 1467 | HPV | 16 | 3 | 14 | Cw*0401 | KFSADLDQF | 2001 | 200.00 | 9 |
| 1468 | HPV | 16 | 3 | 14 | B62 | DQFPLGRKF | 2002 | 192.00 | 9 |
| 1469 | HPV | 16 | 3 | 14 | Cw*0401 | QFPLGRKFL | 2003 | 200.00 | 9 |
| 1470 | HPV | 16 | 3 | 14 | B*5102 | FPLGRKFLL | 2004 | 660.00 | 9 |
| 1471 | HPV | 16 | 3 | 14 | B*2705 | KRKATPTTS | 2005 | 600.00 | 9 |
| 1472 | HPV | 16 | 3 | 14 | B8 | TAKRKKRKL | 2006 | 320.00 | 9 |
| 1473 | HPV | 16 | 3 | 14 | Cw*0401 | VYHIFFQMSL | 2007 | 330.00 | 10 |
| 1474 | HPV | 16 | 3 | 14 | A24 | VYHIFFQMSL | 2007 | 200.00 | 10 |
| 1475 | HPV | 16 | 3 | 14 | A*0201 | SLWLPSEATV | 2008 | 577.28 | 10 |
| 1476 | HPV | 16 | 3 | 14 | A*0201 | WLPSEATVYL | 2009 | 540.47 | 10 |
| 1477 | HPV | 16 | 3 | 14 | A*0201 | YLPPVPSKV | 2010 | 735.86 | 10 |
| 1478 | HPV | 16 | 3 | 14 | B*5102 | LPPVPVSKVV | 2011 | 242.00 | 10 |
| 1479 | HPV | 16 | 3 | 14 | B*5201 | LPPVPVSKVV | 2011 | 435.60 | 10 |
| 1480 | HPV | 16 | 3 | 14 | A68.1 | VVSTDEYVAR | 2012 | 200.00 | 10 |
| 1481 | HPV | 16 | 3 | 14 | Cw*0401 | IYYHAGTSRL | 2013 | 200.00 | 10 |
| 1482 | HPV | 16 | 3 | 14 | A24 | IYYHAGTSRL | 2013 | 200.00 | 10 |
| 1483 | HPV | 16 | 3 | 14 | Cw*0401 | YYHAGTSRLL | 2014 | 360.00 | 10 |
| 1484 | HPV | 16 | 3 | 14 | A24 | YYHAGTSRLL | 2014 | 200.00 | 10 |
| 1485 | HPV | 16 | 3 | 14 | B*5102 | HAGTSRLLAV | 2015 | 110.00 | 10 |
| 1486 | HPV | 16 | 3 | 14 | B*5103 | HAGTSRLLAV | 2015 | 121.00 | 10 |
| 1487 | HPV | 16 | 3 | 14 | B*2702 | SRLLAVGHPY | 2016 | 200.00 | 10 |
| 1488 | HPV | 16 | 3 | 14 | B*2705 | SRLLAVGHPY | 2016 | 1000.00 | 10 |
| 1489 | HPV | 16 | 3 | 14 | B*5102 | LAVGHPYFPI | 2017 | 660.00 | 10 |
| 1490 | HPV | 16 | 3 | 14 | B*5103 | LAVGHPYFPI | 2017 | 110.00 | 10 |
| 1491 | HPV | 16 | 3 | 14 | A68.1 | AVGHPYFPIK | 2018 | 240.00 | 10 |
| 1492 | HPV | 16 | 3 | 14 | A*0205 | KILVPKVSGL | 2019 | 126.00 | 10 |
| 1493 | HPV | 16 | 3 | 14 | B*5102 | SGLQYRVFRI | 2020 | 528.00 | 10 |
| 1494 | HPV | 16 | 3 | 14 | B*2705 | LQYRVFRIHL | 2021 | 1000.00 | 10 |
| 1495 | HPV | 16 | 3 | 14 | B*2705 | FRIHLPDPNK | 2022 | 2000.00 | 10 |
| 1496 | HPV | 16 | 3 | 14 | Cw*0401 | SFYNPDTQRL | 2023 | 200.00 | 10 |
| 1497 | HPV | 16 | 3 | 14 | B*2705 | QRLVWACVGV | 2024 | 600.00 | 10 |
| 1498 | HPV | 16 | 3 | 14 | B*2705 | GRGQPLGVGI | 2025 | 600.00 | 10 |
| 1499 | HPV | 16 | 3 | 14 | B*5102 | NAGVDNRECI | 2026 | 242.00 | 10 |
| 1500 | HPV | 16 | 3 | 14 | B*5103 | NAGVDNRECI | 2026 | 121.00 | 10 |
| 1501 | HPV | 16 | 3 | 14 | B*2705 | NRECISMDYK | 2027 | 2000.00 | 10 |
| 1502 | HPV | 16 | 3 | 14 | B7 | NPGDCPPLEL | 2028 | 120.00 | 10 |
| 1503 | HPV | 16 | 3 | 14 | B*5102 | NPGDCPPLEL | 2028 | 100.00 | 10 |
| 1504 | HPV | 16 | 3 | 14 | B*5102 | CPPLELINTV | 2029 | 266.20 | 10 |
| 1505 | HPV | 16 | 3 | 14 | B*5102 | PPLELINTVI | 2030 | 145.20 | 10 |
| 1506 | HPV | 16 | 3 | 14 | Cw*0401 | GFGAMDFTTL | 2031 | 200.00 | 10 |
| 1507 | HPV | 16 | 3 | 14 | B*2705 | LQANKSEVPL | 2032 | 200.00 | 10 |
| 1508 | HPV | 16 | 3 | 14 | A1 | VSEPYGDSLF | 2033 | 135.00 | 10 |
| 1509 | HPV | 16 | 3 | 14 | Cw*0401 | LFFYLRREQM | 2034 | 110.00 | 10 |
| 1510 | HPV | 16 | 3 | 14 | Cw*0401 | FFYLRREQMF | 2035 | 110.00 | 10 |

TABLE 7-continued

| No | Species | Strain type | Frame | ORF | HLA | Seq | Seq ID No. | Score | Length |
|---|---|---|---|---|---|---|---|---|---|
| 1511 | HPV | 16 | 3 | 14 | B*2705 | LRREQMFVRH | 2036 | 200.00 | 10 |
| 1512 | HPV | 16 | 3 | 14 | B*2705 | RREQMFVRHL | 2037 | 1800.00 | 10 |
| 1513 | HPV | 16 | 3 | 14 | B*2705 | QMFVRHLFNR | 2038 | 125.00 | 10 |
| 1514 | HPV | 16 | 3 | 14 | B*2705 | VRHLFNRAGT | 2039 | 200.00 | 10 |
| 1515 | HPV | 16 | 3 | 14 | B*2705 | NRAGTVGENV | 2040 | 600.00 | 10 |
| 1516 | HPV | 16 | 3 | 14 | Cw*0401 | NYFPTPSGSM | 2041 | 132.00 | 10 |
| 1517 | HPV | 16 | 3 | 14 | B*2705 | AQIFNKPYWL | 2042 | 200.00 | 10 |
| 1518 | HPV | 16 | 3 | 14 | B*2705 | QRAQGHNNGI | 2043 | 600.00 | 10 |
| 1519 | HPV | 16 | 3 | 14 | B*2705 | TRSTNMSLCA | 2044 | 200.00 | 10 |
| 1520 | HPV | 16 | 3 | 14 | B*2705 | KEYLRHGEEY | 2045 | 225.00 | 10 |
| 1521 | HPV | 16 | 3 | 14 | Cw*0401 | EYDLQFIFQL | 2046 | 600.00 | 10 |
| 1522 | HPV | 16 | 3 | 14 | A24 | EYDLQFIFQL | 2046 | 200.00 | 10 |
| 1523 | HPV | 16 | 3 | 14 | B*2705 | LQFIFQLCKI | 2047 | 300.00 | 10 |
| 1524 | HPV | 16 | 3 | 14 | A*0201 | TLTADVMTYI | 2048 | 131.97 | 10 |
| 1525 | HPV | 16 | 3 | 14 | A*0201 | TILEDWNFGL | 2049 | 258.44 | 10 |
| 1526 | HPV | 16 | 3 | 14 | B*2702 | YRFVTQAIAC | 2050 | 100.00 | 10 |
| 1527 | HPV | 16 | 3 | 14 | B*2705 | YRFVTQAIAC | 2050 | 1000.00 | 10 |
| 1528 | HPV | 16 | 3 | 14 | A68.1 | FVTQAIACQK | 2051 | 120.00 | 10 |
| 1529 | HPV | 16 | 3 | 14 | B*2705 | CQKHTPPAPK | 2052 | 200.00 | 10 |
| 1530 | HPV | 16 | 3 | 14 | Cw*0401 | QFPLGRKFLL | 2053 | 220.00 | 10 |
| 1531 | HPV | 16 | 3 | 14 | B*2705 | GRKFLLQAGL | 2054 | 2000.00 | 10 |
| 1532 | HPV | 16 | 3 | 14 | B*2705 | KRKATPTTSS | 2055 | 600.00 | 10 |
| 1533 | HPV | 16 | 3 | 15 | Cw*0401 | FFTLHYVQL | 2056 | 220.00 | 9 |
| 1534 | HPV | 16 | 3 | 15 | A*0201 | YVQLLNHYV | 2057 | 153.97 | 9 |
| 1535 | HPV | 16 | 3 | 15 | A*0201 | LLNHYVHCV | 2058 | 271.95 | 9 |
| 1536 | HPV | 16 | 3 | 15 | A*0201 | CLPTIPLFFT | 2059 | 546.75 | 10 |
| 1537 | HPV | 16 | 3 | 15 | B*5102 | LPTIPLFFTL | 2060 | 110.00 | 10 |
| 1538 | HPV | 16 | 3 | 15 | B*5102 | IPLFFTLHYV | 2061 | 726.00 | 10 |
| 1539 | HPV | 116 | 3 | 15 | Cw*0401 | LFFTLHYVQL | 2062 | 220.00 | 10 |
| 1540 | HPV | 16 | 3 | 15 | Cw*0401 | FFTLHYVQLL | 2063 | 400.00 | 10 |
| 1541 | HPV | 16 | 3 | 15 | A*0201 | QLLNHYVHCV | 2064 | 591.89 | 10 |
| 1542 | HPV | 16 | 3 | 2 | B*5102 | MGIHMLYV | 2065 | 132.00 | 8 |
| 1543 | HPV | 16 | 3 | 2 | B*5201 | MGIHMLYVI | 2066 | 272.25 | 9 |
| 1544 | HPV | 16 | 3 | 2 | B*5102 | MGIHMLYVI | 2066 | 264.00 | 9 |
| 1545 | HPV | 16 | 3 | 3 | B*2705 | CRGCSGKK | 2067 | 600.00 | 8 |
| 1546 | HPV | 16 | 3 | 3 | A68.1 | MVLCRGCSGK | 2068 | 240.00 | 10 |
| 1547 | HPV | 16 | 3 | 3 | B*2705 | CRGCSGKKNR | 2069 | 300.00 | 10 |
| 1548 | HPV | 16 | 3 | 4 | B*5102 | YGVSFSEL | 2070 | 132.00 | 8 |
| 1549 | HPV | 16 | 3 | 4 | B*2705 | VRPFKSNK | 2071 | 2000.00 | 8 |
| 1550 | HPV | 16 | 3 | 4 | B*5102 | TPSIADSI | 2072 | 400.00 | 8 |
| 1551 | HPV | 16 | 3 | 4 | B*2705 | LQQYCLYL | 2073 | 200.00 | 8 |
| 1552 | HPV | 16 | 3 | 4 | B*2705 | QQYCLYLH | 2074 | 100.00 | 8 |
| 1553 | HPV | 16 | 3 | 4 | B*5102 | LACSWGMV | 2075 | 100.00 | 8 |
| 1554 | HPV | 16 | 3 | 4 | B*2705 | VRYKCGKN | 2076 | 300.00 | 8 |
| 1555 | HPV | 16 | 3 | 4 | B*2705 | NRETIEKL | 2077 | 600.00 | 8 |
| 1556 | HPV | 16 | 3 | 4 | B*2705 | LRSTAAAL | 1709 | 2000.00 | 8 |
| 1557 | HPV | 16 | 3 | 4 | B*2705 | QRQTVLQH | 1710 | 200.00 | 8 |
| 1558 | HPV | 16 | 3 | 4 | B*2705 | SQMVQWAY | 1711 | 100.00 | 8 |
| 1559 | HPV | 16 | 3 | 4 | B*5102 | WAYDNDIV | 1712 | 550.00 | 8 |
| 1560 | HPV | 16 | 3 | 4 | B*5102 | IAYKYAQL | 1713 | 302.50 | 8 |
| 1561 | HPV | 16 | 3 | 4 | B*2705 | KRAEKKQM | 1714 | 1800.00 | 8 |
| 1562 | HPV | 16 | 3 | 4 | B*2705 | KQIVMFLR | 1715 | 300.00 | 8 |
| 1563 | HPV | 16 | 3 | 4 | B*2705 | LRYQGVEF | 1716 | 5000.00 | 8 |
| 1564 | HPV | 16 | 3 | 4 | B*2705 | KRFLQGIP | 1717 | 300.00 | 8 |
| 1565 | HPV | 16 | 3 | 4 | B*2705 | LQGSVICF | 1718 | 100.00 | 8 |
| 1566 | HPV | 16 | 3 | 4 | B*3901 | SHFWLQPL | 1719 | 180.00 | 8 |
| 1567 | HPV | 16 | 3 | 4 | B*2705 | LQPLADAK | 1720 | 200.00 | 8 |
| 1568 | HPV | 16 | 3 | 4 | B*5102 | QPLADAKI | 1721 | 1320.00 | 8 |
| 1569 | HPV | 16 | 3 | 4 | B*2705 | WNYIDDNL | 1722 | 100.00 | 8 |
| 1570 | HPV | 16 | 3 | 4 | B*2705 | LRNALDGN | 1723 | 200.00 | 8 |
| 1571 | HPV | 16 | 3 | 4 | B*5102 | NALDGNLV | 1724 | 363.00 | 8 |
| 1572 | HPV | 16 | 3 | 4 | B*2705 | HRPLVQLK | 1725 | 2000.00 | 8 |
| 1573 | HPV | 16 | 3 | 4 | B*2705 | VQLKCPPL | 1726 | 200.00 | 8 |
| 1574 | HPV | 16 | 3 | 4 | B*2705 | SRWPYLHN | 1727 | 1000.00 | 8 |
| 1575 | HPV | 16 | 3 | 4 | B*5102 | WPYLHNRL | 1728 | 665.50 | 8 |
| 1576 | HPV | 16 | 3 | 4 | B*2705 | NRLVVFTF | 1729 | 1000.00 | 8 |
| 1577 | HPV | 16 | 3 | 4 | B*2705 | SRTWSRLS | 1730 | 200.00 | 8 |
| 1578 | HPV | 16 | 3 | 4 | B*2705 | RTWSRLSL | 1731 | 150.00 | 8 |
| 1579 | HPV | 16 | 3 | 4 | B*2705 | GRHETETPC | 2078 | 200.00 | 9 |
| 1580 | HPV | 16 | 3 | 4 | A1 | ETETPCSQY | 2079 | 112.50 | 9 |
| 1581 | HPV | 16 | 3 | 4 | B*5102 | EGVSERHTI | 2080 | 264.00 | 9 |
| 1582 | HPV | 16 | 3 | 4 | B*2705 | CQTPLTNIL | 2081 | 200.00 | 9 |
| 1583 | HPV | 16 | 3 | 4 | B*5102 | TPLTNILNV | 2082 | 798.60 | 9 |
| 1584 | HPV | 16 | 3 | 4 | A68.1 | NVLKTSNAK | 2083 | 240.00 | 9 |
| 1585 | HPV | 16 | 3 | 4 | A*0201 | AMLAKFKEL | 2084 | 108.46 | 9 |
| 1586 | HPV | 16 | 3 | 4 | Cw*0301 | AMLAKFKEL | 2084 | 120.00 | 9 |

TABLE 7-continued

| No | Species | Strain type | Frame | ORF | HLA | Seq | Seq ID No. | Score | Length |
|---|---|---|---|---|---|---|---|---|---|
| 1587 | HPV | 16 | 3 | 4 | A24 | LYGVSFSEL | 2085 | 264.00 | 9 |
| 1588 | HPV | 16 | 3 | 4 | Cw*0401 | LYGVSFSEL | 2085 | 200.00 | 9 |
| 1589 | HPV | 16 | 3 | 4 | B*5102 | YGVSFSELV | 2086 | 264.00 | 9 |
| 1590 | HPV | 16 | 3 | 4 | A68.1 | GVSFSELVR | 2087 | 300.00 | 9 |
| 1591 | HPV | 16 | 3 | 4 | Cw*0401 | SFSELVRPF | 2088 | 240.00 | 9 |
| 1592 | HPV | 16 | 3 | 4 | A68.1 | LVRPFKSNK | 2089 | 180.00 | 9 |
| 1593 | HPV | 16 | 3 | 4 | B*2705 | VRPFKSNKS | 2090 | 200.00 | 9 |
| 1594 | HPV | 16 | 3 | 4 | B*5103 | AAFGLTPSI | 2091 | 145.20 | 9 |
| 1595 | HPV | 16 | 3 | 4 | B*5102 | AAFGLTPSI | 2091 | 1210.00 | 9 |
| 1596 | HPV | 16 | 3 | 4 | A*0201 | LLQQYCLYL | 2092 | 199.74 | 9 |
| 1597 | HPV | 16 | 3 | 4 | B*2705 | QQYCLYLHI | 2093 | 300.00 | 9 |
| 1598 | HPV | 16 | 3 | 4 | B*5201 | QQYCLYLHI | 2093 | 100.00 | 9 |
| 1599 | HPV | 16 | 3 | 4 | A*0201 | CLYLHIQSL | 2094 | 157.23 | 9 |
| 1600 | HPV | 16 | 3 | 4 | B*2705 | CLYLHIQSL | 2094 | 150.00 | 9 |
| 1601 | HPV | 16 | 3 | 4 | B*5103 | LACSWGMVV | 2095 | 110.00 | 9 |
| 1602 | HPV | 16 | 3 | 4 | B*5102 | LACSWGMVV | 2095 | 100.00 | 9 |
| 1603 | HPV | 16 | 3 | 4 | A68.1 | VVLLLVRYK | 2096 | 240.00 | 9 |
| 1604 | HPV | 16 | 3 | 4 | B*2705 | VRYKCGKNR | 2097 | 1500.00 | 9 |
| 1605 | HPV | 16 | 3 | 4 | B*2705 | NRETIEKLL | 2098 | 600.00 | 9 |
| 1606 | HPV | 16 | 3 | 4 | A68.1 | ETIEKLLSK | 2099 | 180.00 | 9 |
| 1607 | HPV | 16 | 3 | 4 | B60 | IEKLLSKLL | 2100 | 176.00 | 9 |
| 1608 | HPV | 16 | 3 | 4 | A*0201 | KLLSKLLCV | 2101 | 2071.61 | 9 |
| 1609 | HPV | 16 | 3 | 4 | B*2702 | LRSTAAALY | 1732 | 200.00 | 9 |
| 1610 | HPV | 16 | 3 | 4 | B*2705 | LRSTAAALY | 1732 | 1000.00 | 9 |
| 1611 | HPV | 16 | 3 | 4 | B*5801 | RSTAAALYW | 1733 | 264.00 | 9 |
| 1612 | HPV | 16 | 3 | 4 | B*5102 | TGISNISEV | 1734 | 145.20 | 9 |
| 1613 | HPV | 16 | 3 | 4 | B*2705 | QRQTVLQHS | 1735 | 200.00 | 9 |
| 1614 | HPV | 16 | 3 | 4 | B*2705 | RQTVLQHSF | 1736 | 300.00 | 9 |
| 1615 | HPV | 16 | 3 | 4 | B62 | RQTVLQHSF | 1736 | 160.00 | 9 |
| 1616 | HPV | 16 | 3 | 4 | Cw*0401 | SFNDCTFEL | 1737 | 240.00 | 9 |
| 1617 | HPV | 16 | 3 | 4 | B*2705 | VQWAYDNDI | 1738 | 300.00 | 9 |
| 1618 | HPV | 16 | 3 | 4 | A1 | IVDDSEIAY | 1739 | 125.00 | 9 |
| 1619 | HPV | 16 | 3 | 4 | A68.1 | ATMCRHYKR | 1740 | 100.00 | 9 |
| 1620 | HPV | 16 | 3 | 4 | B*2705 | CRHYKRAEK | 1741 | 2000.00 | 9 |
| 1621 | HPV | 16 | 3 | 4 | B*2705 | KRAEKKQMS | 1742 | 600.00 | 9 |
| 1622 | HPV | 16 | 3 | 4 | B*2705 | KQMSMSQWI | 1743 | 180.00 | 9 |
| 1623 | HPV | 16 | 3 | 4 | A68.1 | RVDDGGDWK | 1744 | 120.00 | 9 |
| 1624 | HPV | 16 | 3 | 4 | B*2705 | KQIVMFLRY | 1745 | 300.00 | 9 |
| 1625 | HPV | 16 | 3 | 4 | A*0201 | VMFLRYQGV | 1746 | 473.94 | 9 |
| 1626 | HPV | 16 | 3 | 4 | B62 | FLRYQGVEF | 1747 | 144.00 | 9 |
| 1627 | HPV | 16 | 3 | 4 | B*2702 | LRYQGVEFM | 1748 | 100.00 | 9 |
| 1628 | HPV | 16 | 3 | 4 | B*2705 | LRYQGVEFM | 1748 | 3000.00 | 9 |
| 1629 | HPV | 16 | 3 | 4 | B*2705 | YQGVEFMSF | 1749 | 100.00 | 9 |
| 1630 | HPV | 16 | 3 | 4 | B62 | YQGVEFMSF | 1749 | 160.00 | 9 |
| 1631 | HPV | 16 | 3 | 4 | Cw*0401 | EFMSFLTAL | 1750 | 400.00 | 9 |
| 1632 | HPV | 16 | 3 | 4 | Cw*0401 | SFLTALKRF | 1751 | 220.00 | 9 |
| 1633 | HPV | 16 | 3 | 4 | A*0201 | FLTALKRFL | 1752 | 108.09 | 9 |
| 1634 | HPV | 16 | 3 | 4 | B*2705 | KRFLQGIPK | 1753 | 30000.00 | 9 |
| 1635 | HPV | 16 | 3 | 4 | B*5102 | QGIPKKNCI | 1754 | 240.00 | 9 |
| 1636 | HPV | 16 | 3 | 4 | A3 | SLFGMSLMK | 1755 | 300.00 | 9 |
| 1637 | HPV | 16 | 3 | 4 | B*2705 | SLFGMSLMK | 1755 | 150.00 | 9 |
| 1638 | HPV | 16 | 3 | 4 | Cw*0401 | LFGMSLMKF | 1756 | 220.00 | 9 |
| 1639 | HPV | 16 | 3 | 4 | A*0201 | LQGSVICFV | 1757 | 151.65 | 9 |
| 1640 | HPV | 16 | 3 | 4 | A68.1 | SVICFVNSK | 1758 | 240.00 | 9 |
| 1641 | HPV | 16 | 3 | 4 | Cw*0401 | CFVNSKSHF | 1759 | 110.00 | 9 |
| 1642 | HPV | 16 | 3 | 4 | B*2705 | LRNALDGNL | 1760 | 2000.00 | 9 |
| 1643 | HPV | 16 | 3 | 4 | A68.1 | LVSMDVKHR | 1761 | 300.00 | 9 |
| 1644 | HPV | 16 | 3 | 4 | B*2705 | HRPLVQLKC | 1762 | 200.00 | 9 |
| 1645 | HPV | 16 | 3 | 4 | B*2705 | VQLKCPPLL | 1763 | 200.00 | 9 |
| 1646 | HPV | 16 | 3 | 4 | B*5102 | PPLLITSNI | 1764 | 145.20 | 9 |
| 1647 | HPV | 16 | 3 | 4 | B*2705 | SRWPYLHNR | 1765 | 5000.00 | 9 |
| 1648 | HPV | 16 | 3 | 4 | B*5103 | WPYLHNRLV | 1766 | 132.00 | 9 |
| 1649 | HPV | 16 | 3 | 4 | B*5102 | WPYLHNRLV | 1766 | 1331.00 | 9 |
| 1650 | HPV | 16 | 3 | 4 | B*2705 | KNWKSFFSR | 1767 | 150.00 | 9 |
| 1651 | HPV | 16 | 3 | 4 | Cw*0401 | FFSRTWSRL | 1768 | 240.00 | 9 |
| 1652 | HPV | 16 | 3 | 4 | B14 | SRTWSRLSL | 1769 | 100.00 | 9 |
| 1653 | HPV | 16 | 3 | 4 | B*2705 | SRTWSRLSL | 1769 | 2000.00 | 9 |
| 1654 | HPV | 16 | 3 | 4 | B*2705 | GRHETETPCS | 2102 | 200.00 | 10 |
| 1655 | HPV | 16 | 3 | 4 | B*2705 | ERHTICQTPL | 2103 | 200.00 | 10 |
| 1656 | HPV | 16 | 3 | 4 | B*5102 | TPLTNILNVL | 2104 | 330.00 | 10 |
| 1657 | HPV | 16 | 3 | 4 | Cw*0401 | TPLTNILNVL | 2104 | 160.00 | 10 |
| 1658 | HPV | 16 | 3 | 4 | B7 | AAMLAKFKEL | 2105 | 108.00 | 10 |
| 1659 | HPV | 16 | 3 | 4 | Cw*0301 | AAMLAKFKEL | 2105 | 240.00 | 10 |
| 1660 | HPV | 16 | 3 | 4 | B*5103 | LAKFKELYGV | 2106 | 100.00 | 10 |
| 1661 | HPV | 16 | 3 | 4 | Cw*0401 | KFKELYGVSF | 2107 | 132.00 | 10 |
| 1662 | HPV | 16 | 3 | 4 | Cw*0301 | ELYGVSFSEL | 2108 | 120.00 | 10 |

TABLE 7-continued

| No | Species | Strain type | Frame | ORF | HLA | Seq | Seq ID No. | Score | Length |
|---|---|---|---|---|---|---|---|---|---|
| 1663 | HPV | 16 | 3 | 4 | B*5801 | KSNKSTCCDW | 2109 | 480.00 | 10 |
| 1664 | HPV | 16 | 3 | 4 | B*5102 | IAAFGLTPSI | 2110 | 220.00 | 10 |
| 1665 | HPV | 16 | 3 | 4 | B*5103 | IAAFGLTPSI | 2110 | 110.00 | 10 |
| 1666 | HPV | 16 | 3 | 4 | A*0201 | TLLQQYCLYL | 2111 | 434.72 | 10 |
| 1667 | HPV | 16 | 3 | 4 | A68.1 | MVVLLLVRYK | 2112 | 240.00 | 10 |
| 1668 | HPV | 16 | 3 | 4 | A68.1 | LVRYKCGKNR | 2113 | 200.00 | 10 |
| 1669 | HPV | 16 | 3 | 4 | B*2705 | VRYKCGKNRE | 2114 | 100.00 | 10 |
| 1670 | HPV | 16 | 3 | 4 | B*2705 | NRETIEKLLS | 2115 | 200.00 | 10 |
| 1671 | HPV | 16 | 3 | 4 | B62 | KLRSTAAALY | 1770 | 120.00 | 10 |
| 1672 | HPV | 16 | 3 | 4 | B*2702 | LRSTAAALYW | 1771 | 100.00 | 10 |
| 1673 | HPV | 16 | 3 | 4 | B*2705 | LRSTAAALYW | 1771 | 200.00 | 10 |
| 1674 | HPV | 16 | 3 | 4 | B*5102 | AALYWYKTGI | 1772 | 600.00 | 10 |
| 1675 | HPV | 16 | 3 | 4 | B*5103 | AALYWYKTGI | 1772 | 132.00 | 10 |
| 1676 | HPV | 16 | 3 | 4 | B*5102 | TPEWIQRQTV | 1773 | 133.10 | 10 |
| 1677 | HPV | 16 | 3 | 4 | B*2702 | QRQTVLQHSF | 1774 | 200.00 | 10 |
| 1678 | HPV | 16 | 3 | 4 | B*2705 | QRQTVLQHSF | 1774 | 1000.00 | 10 |
| 1679 | HPV | 16 | 3 | 4 | B*2705 | LQHSFNDCTF | 1775 | 100.00 | 10 |
| 1680 | HPV | 16 | 3 | 4 | B*2705 | VQWAYDNDIV | 1776 | 300.00 | 10 |
| 1681 | HPV | 16 | 3 | 4 | B*5201 | VQWAYDNDIV | 1776 | 990.00 | 10 |
| 1682 | HPV | 16 | 3 | 4 | A68.1 | IVDDSEIAYK | 1777 | 120.00 | 10 |
| 1683 | HPV | 16 | 3 | 4 | B60 | SEIAYKYAQL | 1778 | 352.00 | 10 |
| 1684 | HPV | 16 | 3 | 4 | Cw*0301 | SEIAYKYAQL | 1778 | 100.00 | 10 |
| 1685 | HPV | 16 | 3 | 4 | A68.1 | IVKDCATMCR | 1779 | 200.00 | 10 |
| 1686 | HPV | 16 | 3 | 4 | B*2705 | CRHYKRAEKK | 1780 | 2000.00 | 10 |
| 1687 | HPV | 16 | 3 | 4 | Cw*0401 | HYKRAEKKQM | 1781 | 100.00 | 10 |
| 1688 | HPV | 16 | 3 | 4 | B*2705 | KRAEKKQMSM | 1782 | 1800.00 | 10 |
| 1689 | HPV | 16 | 3 | 4 | B*2705 | KQMSMSQWIK | 1783 | 600.00 | 10 |
| 1690 | HPV | 16 | 3 | 4 | B*2705 | SQWIKYRCDR | 1784 | 500.00 | 10 |
| 1691 | HPV | 16 | 3 | 4 | B*2705 | DRVDDGGDWK | 1785 | 200.00 | 10 |
| 1692 | HPV | 16 | 3 | 4 | B*3701 | GDWKQIVMFL | 1786 | 300.00 | 10 |
| 1693 | HPV | 16 | 3 | 4 | Cw*0401 | MFLRYQGVEF | 1787 | 100.00 | 10 |
| 1694 | HPV | 16 | 3 | 4 | B*2705 | LRYQGVEFMS | 1788 | 1000.00 | 10 |
| 1695 | HPV | 16 | 3 | 4 | Cw*0401 | RYQGVEFMSF | 1789 | 110.00 | 10 |
| 1696 | HPV | 16 | 3 | 4 | A24 | RYQGVEFMSF | 1789 | 360.00 | 10 |
| 1697 | HPV | 16 | 3 | 4 | A*0201 | YQGVEFMSFL | 1790 | 478.93 | 10 |
| 1698 | HPV | 16 | 3 | 4 | B*2705 | YQGVEFMSFL | 1790 | 200.00 | 10 |
| 1699 | HPV | 16 | 3 | 4 | B*2705 | VEFMSFLTAL | 1791 | 150.00 | 10 |
| 1700 | HPV | 16 | 3 | 4 | B60 | VEFMSFLTAL | 1791 | 160.00 | 10 |
| 1701 | HPV | 16 | 3 | 4 | Cw*0401 | SFLTALKRFL | 1792 | 200.00 | 10 |
| 1702 | HPV | 16 | 3 | 4 | B*5102 | TALKRFLQGI | 1793 | 726.00 | 10 |
| 1703 | HPV | 16 | 3 | 4 | B*5103 | TALKRFLQGI | 1793 | 132.00 | 10 |
| 1704 | HPV | 16 | 3 | 4 | B*2705 | KRFLQGIPKK | 1794 | 30000.00 | 10 |
| 1705 | HPV | 16 | 3 | 4 | Cw*0301 | QGIPKKNCIL | 1795 | 100.00 | 10 |
| 1706 | HPV | 16 | 3 | 4 | B*3501 | IPKKNCILLY | 1796 | 120.00 | 10 |
| 1707 | HPV | 16 | 3 | 4 | A3 | LLYGAANTGK | 1797 | 150.00 | 10 |
| 1708 | HPV | 16 | 3 | 4 | B*2705 | LLYGAANTGK | 1797 | 150.00 | 10 |
| 1709 | HPV | 16 | 3 | 4 | Cw*0401 | LFGMSLMKFL | 1798 | 240.00 | 10 |
| 1710 | HPV | 16 | 3 | 4 | Cw*0401 | KFLQGSVICF | 1799 | 200.00 | 10 |
| 1711 | HPV | 16 | 3 | 4 | A*0201 | FLQGSVICFV | 1800 | 4047.23 | 10 |
| 1712 | HPV | 16 | 3 | 4 | A*0201 | FVNSKSHFWL | 1801 | 274.29 | 10 |
| 1713 | HPV | 16 | 3 | 4 | B*5102 | DATVPCWNYI | 1802 | 220.00 | 10 |
| 1714 | HPV | 16 | 3 | 4 | B*5103 | DATVPCWNYI | 1802 | 121.00 | 10 |
| 1715 | HPV | 16 | 3 | 4 | B*2705 | LRNALDGNLV | 1803 | 600.00 | 10 |
| 1716 | HPV | 16 | 3 | 4 | B*5102 | CPPLLITSNI | 1804 | 484.00 | 10 |
| 1717 | HPV | 16 | 3 | 4 | B*2702 | SRWPYLHNRL | 1805 | 300.00 | 10 |
| 1718 | HPV | 16 | 3 | 4 | B*2705 | SRWPYLHNRL | 1805 | 10000.00 | 10 |
| 1719 | HPV | 16 | 3 | 4 | B*5102 | WPYLHNRLVV | 1806 | 1210.00 | 10 |
| 1720 | HPV | 16 | 3 | 4 | B*5103 | WPYLHNRLVV | 1806 | 145.20 | 10 |
| 1721 | HPV | 16 | 3 | 4 | B*5201 | WPYLHNRLVV | 1806 | 300.00 | 10 |
| 1722 | HPV | 16 | 3 | 4 | A*0201 | YLHNRLVVFT | 1807 | 433.63 | 10 |
| 1723 | HPV | 16 | 3 | 4 | B*2705 | NRLVVFTFPN | 1808 | 200.00 | 10 |
| 1724 | HPV | 16 | 3 | 4 | Cw*0401 | VFTFPNEFPF | 1809 | 100.00 | 10 |
| 1725 | HPV | 16 | 3 | 4 | B*5102 | FPFDENGNPV | 1810 | 2200.00 | 10 |
| 1726 | HPV | 16 | 3 | 4 | B60 | DENGNPVYEL | 1811 | 320.00 | 10 |
| 1727 | HPV | 16 | 3 | 4 | Cw*0401 | SFFSRTWSRL | 1812 | 240.00 | 10 |
| 1728 | HPV | 16 | 3 | 4 | B*2705 | SRTWSRLSLH | 1813 | 200.00 | 10 |
| 1729 | HPV | 16 | 3 | 4 | A*0201 | YLLQGQRNGI | 2116 | 177.57 | 10 |
| 1730 | HPV | 16 | 3 | 5 | B*2705 | MQYNALYK | 2117 | 1000.00 | 8 |
| 1731 | HPV | 16 | 3 | 7 | B*2705 | MQYNALYKL | 2118 | 1000.00 | 9 |
| 1732 | HPV | 16 | 3 | 7 | A*0201 | ALYKLDTYI | 2119 | 183.62 | 9 |
| 1733 | HPV | 16 | 3 | 7 | Cw*0301 | YKLDTYIYL | 2120 | 100.00 | 9 |
| 1734 | HPV | 16 | 3 | 7 | B*5102 | NALYKLDTYI | 2121 | 660.00 | 10 |
| 1735 | HPV | 16 | 3 | 7 | B*5103 | NALYKLDTYI | 2121 | 120.00 | 10 |
| 1736 | HPV | 16 | 3 | 7 | Cw*0401 | LYKLDTYIYL | 2122 | 240.00 | 10 |
| 1737 | HPV | 16 | 3 | 7 | A24 | LYKLDTYIYL | 2122 | 200.00 | 10 |
| 1738 | HPV | 16 | 3 | 9 | B*3701 | LDTASTTLL | 2123 | 200.00 | 9 |

TABLE 7-continued

| No | Species | Strain type | Frame | ORF | HLA | Seq | Seq ID No. | Score | Length |
|---|---|---|---|---|---|---|---|---|---|
| 1739 | HPV | 16 | 3 | 9 | B*5103 | LACFLLCFV | 1814 | 100.00 | 9 |
| 1740 | HPV | 16 | 3 | 9 | B*5102 | LACFLLCFV | 1814 | 100.00 | 9 |
| 1741 | HPV | 16 | 3 | 9 | Cw*0401 | CFLLCFVCF | 1815 | 100.00 | 9 |
| 1742 | HPV | 16 | 3 | 9 | A*0201 | FLLCFVCFC | 1816 | 4064.58 | 9 |
| 1743 | HPV | 16 | 3 | 9 | A*0201 | LLCFVCFCV | 1817 | 685.78 | 9 |
| 1744 | HPV | 16 | 3 | 9 | A*0201 | LLACFLLCFV | 2124 | 1495.72 | 10 |
| 1745 | HPV | 16 | 3 | 9 | A*0201 | FLLCFVCFCV | 1818 | 6865.90 | 10 |
| 1746 | HPV | 16 | 3 | 11 | B*2705 | HQHLYLPF | 1863 | 100.00 | 8 |
| 1747 | HPV | 16 | 3 | 11 | B*5102 | FPQMYQDL | 1864 | 220.00 | 8 |
| 1748 | HPV | 16 | 3 | 11 | B*2705 | QMYQDLVL | 1865 | 250.00 | 8 |
| 1749 | HPV | 16 | 3 | 11 | B*2705 | YQDLVLLL | 1866 | 200.00 | 8 |
| 1750 | HPV | 16 | 3 | 11 | B*2705 | LQLIPHLL | 1867 | 200.00 | 8 |
| 1751 | HPV | 16 | 3 | 11 | A*0201 | MLVHQHLYL | 2125 | 199.74 | 9 |
| 1752 | HPV | 16 | 3 | 11 | B*5102 | FPQMYQDLV | 1868 | 440.00 | 9 |
| 1753 | HPV | 16 | 3 | 11 | A*0201 | QMYQDLVLL | 1869 | 113.55 | 9 |
| 1754 | HPV | 16 | 3 | 11 | B*2705 | QMYQDLVLL | 1869 | 250.00 | 9 |
| 1755 | HPV | 16 | 3 | 11 | A24 | MYQDLVLLL | 1870 | 432.00 | 9 |
| 1756 | HPV | 16 | 3 | 11 | Cw*0401 | MYQDLVLLL | 1870 | 480.00 | 9 |
| 1757 | HPV | 16 | 3 | 11 | A*0201 | LLLQLIPHL | 1871 | 309.05 | 9 |
| 1758 | HPV | 16 | 3 | 11 | B*2705 | LQLIPHLLY | 1872 | 100.00 | 9 |
| 1759 | HPV | 16 | 3 | 11 | B*5102 | LPFPQMYQDL | 1873 | 550.00 | 10 |
| 1760 | HPV | 16 | 3 | 11 | Cw*0301 | LPFPQMYQDL | 1873 | 180.00 | 10 |
| 1761 | HPV | 16 | 3 | 11 | Cw*0401 | LPFPQMYQDL | 1873 | 105.60 | 10 |
| 1762 | HPV | 16 | 3 | 11 | B*5102 | FPQMYQDLVL | 1874 | 220.00 | 10 |
| 1763 | HPV | 16 | 3 | 11 | A*0201 | QMYQDLVLLL | 1875 | 113.55 | 10 |
| 1764 | HPV | 16 | 3 | 11 | B*2705 | QMYQDLVLLL | 1875 | 250.00 | 10 |
| 1765 | HPV | 16 | 3 | 11 | B*2705 | YQDLVLLLQL | 1876 | 200.00 | 10 |
| 1766 | HPV | 16 | 3 | 11 | B*3701 | QDLVLLLQLI | 1877 | 200.00 | 10 |
| 1767 | HPV | 16 | 3 | 11 | A*0201 | VLLLQLIPHL | 1878 | 309.05 | 10 |
| 1768 | HPV | 16 | 3 | 11 | A*0201 | LLLQLIPHLL | 1879 | 134.37 | 10 |
| 1769 | HPV | 16 | 3 | 12 | B*2705 | FLWIHLLL | 1884 | 150.00 | 8 |
| 1770 | HPV | 16 | 3 | 12 | Cw*0401 | KFLWIHLLL | 1890 | 200.00 | 9 |
| 1771 | HPV | 16 | 3 | 12 | A*0201 | FLWIHLLLA | 1891 | 436.26 | 9 |
| 1772 | HPV | 16 | 3 | 12 | B*3901 | IHLLLAQTL | 1892 | 180.00 | 9 |
| 1773 | HPV | 16 | 3 | 14 | Cw*0301 | MWIIHYIFL | 2126 | 100.00 | 9 |
| 1774 | HPV | 16 | 3 | 14 | A*0201 | WIIHYIFLV | 2127 | 586.85 | 9 |
| 1775 | HPV | 16 | 3 | 14 | A*0201 | YIFLVMIIV | 2128 | 153.49 | 9 |
| 1776 | HPV | 16 | 3 | 14 | B*5201 | YIFLVMIIV | 2128 | 120.00 | 9 |
| 1777 | HPV | 16 | 3 | 14 | Cw*0401 | IFLVMIIVL | 2129 | 440.00 | 9 |
| 1778 | HPV | 16 | 3 | 14 | A*0201 | FLVMIIVLI | 2130 | 110.38 | 9 |
| 1779 | HPV | 16 | 3 | 14 | A*0205 | YIFLVMIIVL | 2131 | 126.00 | 10 |
| 1780 | HPV | 16 | 3 | 15 | B*2705 | MQPHLLLL | 2132 | 200.00 | 8 |
| 1781 | HPV | 16 | 3 | 15 | B*5102 | QPHLLLLI | 2133 | 440.00 | 8 |
| 1782 | HPV | 16 | 3 | 15 | B*2705 | LQILLQPR | 2134 | 100.00 | 8 |
| 1783 | HPV | 16 | 3 | 15 | B*2705 | LQPRYHLY | 2135 | 100.00 | 8 |
| 1784 | HPV | 16 | 3 | 15 | B*2705 | PRYHLYPL | 2136 | 1000.00 | 8 |
| 1785 | HPV | 16 | 3 | 15 | B*3901 | YHLYPLHL | 2137 | 270.00 | 8 |
| 1786 | HPV | 16 | 3 | 15 | B*5102 | YPLHLYQV | 1904 | 1452.00 | 8 |
| 1787 | HPV | 16 | 3 | 15 | B*2705 | HLYQVIFL | 1905 | 150.00 | 8 |
| 1788 | HPV | 16 | 3 | 15 | B*2705 | LQIQQFLL | 1906 | 200.00 | 8 |
| 1789 | HPV | 16 | 3 | 15 | B*2705 | QQFLLVVH | 1907 | 100.00 | 8 |
| 1790 | HPV | 16 | 3 | 15 | Cw*0401 | QPHLLLLIM | 2138 | 120.00 | 9 |
| 1791 | HPV | 16 | 3 | 15 | A*0201 | LLLLIMDYM | 2139 | 193.70 | 9 |
| 1792 | HPV | 16 | 3 | 15 | A*0201 | LIMDYMIFM | 2140 | 222.85 | 9 |
| 1793 | HPV | 16 | 3 | 15 | B*2705 | MQMTLLQIL | 2141 | 200.00 | 9 |
| 1794 | HPV | 16 | 3 | 15 | B*2705 | LQILLQPRY | 2142 | 100.00 | 9 |
| 1795 | HPV | 16 | 3 | 15 | B62 | LQILLQPRY | 2142 | 160.00 | 9 |
| 1796 | HPV | 16 | 3 | 15 | A*0201 | ILLQPRYHL | 2143 | 134.37 | 9 |
| 1797 | HPV | 16 | 3 | 15 | B7 | QPRYHLYPL | 2144 | 800.00 | 9 |
| 1798 | HPV | 16 | 3 | 15 | Cw*0401 | QPRYHLYPL | 2144 | 176.00 | 9 |
| 1799 | HPV | 16 | 3 | 15 | B*2705 | PRYHLYPLH | 2145 | 100.00 | 9 |
| 1800 | HPV | 16 | 3 | 15 | A24 | RYHLYPLHL | 2146 | 400.00 | 9 |
| 1801 | HPV | 16 | 3 | 15 | Cw*0401 | RYHLYPLHL | 2146 | 330.00 | 9 |
| 1802 | HPV | 16 | 3 | 15 | B*5201 | YPLHLYQVI | 1908 | 220.00 | 9 |
| 1803 | HPV | 16 | 3 | 15 | B*5102 | YPLHLYQVI | 1908 | 2904.00 | 9 |
| 1804 | HPV | 16 | 3 | 15 | B*3901 | LHLYQVIFL | 1909 | 270.00 | 9 |
| 1805 | HPV | 16 | 3 | 15 | A24 | LYQVIFLQI | 1910 | 126.00 | 9 |
| 1806 | HPV | 16 | 3 | 15 | Cw*0401 | IFLQIQQFL | 1911 | 200.00 | 9 |
| 1807 | HPV | 16 | 3 | 15 | A*0201 | FLQIQQFLL | 1912 | 569.95 | 9 |
| 1808 | HPV | 16 | 3 | 15 | B*2705 | QQFLLVVHT | 1913 | 100.00 | 9 |
| 1809 | HPV | 16 | 3 | 15 | A*0201 | LLVVHTIFL | 1914 | 199.74 | 9 |
| 1810 | HPV | 16 | 3 | 15 | B*5201 | MQPHLLLLIM | 2147 | 198.00 | 10 |
| 1811 | HPV | 16 | 3 | 15 | A*0201 | LLIMDYMIFM | 2148 | 106.84 | 10 |
| 1812 | HPV | 16 | 3 | 15 | Cw*0401 | DYMIFMQMTL | 2149 | 220.00 | 10 |
| 1813 | HPV | 16 | 3 | 15 | A24 | DYMIFMQMTL | 2149 | 300.00 | 10 |
| 1814 | HPV | 16 | 3 | 15 | A*0201 | YMIFMQMTLL | 2150 | 163.23 | 10 |

TABLE 7-continued

| No | Species | Strain type | Frame | ORF | HLA | Seq | Seq ID No. | Score | Length |
|---|---|---|---|---|---|---|---|---|---|
| 1815 | HPV | 16 | 3 | 15 | B*2705 | MQMTLLQILL | 2151 | 200.00 | 10 |
| 1816 | HPV | 16 | 3 | 15 | B*2705 | LQPRYHLYPL | 2152 | 200.00 | 10 |
| 1817 | HPV | 16 | 3 | 15 | B*2705 | PRYHLYPLHL | 2153 | 1000.00 | 10 |
| 1818 | HPV | 16 | 3 | 15 | A24 | LYPLHLYQVI | 1915 | 108.00 | 10 |
| 1819 | HPV | 16 | 3 | 15 | A*0201 | VIFLQIQQFL | 1916 | 101.62 | 10 |
| 1820 | HPV | 16 | 3 | 15 | Cw*0401 | IFLQIQQFLL | 1917 | 200.00 | 10 |
| 1821 | HPV | 16 | 3 | 15 | A*0201 | FLQIQQFLLV | 1918 | 607.88 | 10 |
| 1822 | HPV | 16 | 3 | 15 | B*5201 | LQIQQFLLVV | 1919 | 495.00 | 10 |
| 1823 | HPV | 16 | 3 | 15 | B*2705 | QQFLLVVHTI | 1920 | 300.00 | 10 |
| 1824 | HPV | 16 | 3 | 15 | B*5201 | QQFLLVVHTI | 1920 | 120.00 | 10 |
| 1825 | HPV | 16 | 3 | 15 | Cw*0401 | QFLLVVHTIF | 1921 | 100.00 | 10 |
| 1826 | HPV | 16 | 3 | 15 | A*0201 | FLLVVHTIFL | 1922 | 1999.73 | 10 |
| 1827 | HPV | 16 | 3 | 16 | B*2705 | ARTNIYYH | 1923 | 200.00 | 8 |
| 1828 | HPV | 16 | 3 | 16 | B*2705 | SRLLAVGH | 1924 | 200.00 | 8 |
| 1829 | HPV | 16 | 3 | 16 | B*5102 | KPNNNKIL | 1925 | 121.00 | 8 |
| 1830 | HPV | 16 | 3 | 16 | B*5201 | LQYRVFRI | 1926 | 150.00 | 8 |
| 1831 | HPV | 16 | 3 | 16 | B*2705 | YRVFRIHL | 1927 | 2000.00 | 8 |
| 1832 | HPV | 16 | 3 | 16 | B*5102 | NPDTQRLV | 1928 | 121.00 | 8 |
| 1833 | HPV | 16 | 3 | 16 | B*2705 | QRLVWACV | 1929 | 600.00 | 8 |
| 1834 | HPV | 16 | 3 | 16 | B*5102 | WACVGVEV | 1930 | 121.00 | 8 |
| 1835 | HPV | 16 | 3 | 16 | B*2705 | GRGQPLGV | 1931 | 600.00 | 8 |
| 1836 | HPV | 16 | 3 | 16 | B*2705 | KQTQLCLI | 1932 | 180.00 | 8 |
| 1837 | HPV | 16 | 3 | 16 | B*5102 | SPCTNVAV | 1933 | 242.00 | 8 |
| 1838 | HPV | 16 | 3 | 16 | B*5102 | NPGDCPPL | 1934 | 100.00 | 8 |
| 1839 | HPV | 16 | 3 | 16 | B*5102 | YPDYIKMV | 1935 | 200.00 | 8 |
| 1840 | HPV | 16 | 3 | 16 | B*2705 | LRREQMFV | 1936 | 600.00 | 8 |
| 1841 | HPV | 16 | 3 | 16 | B*2705 | RREQMFVR | 1937 | 3000.00 | 8 |
| 1842 | HPV | 16 | 3 | 16 | B*2705 | QMFVRHLF | 1938 | 125.00 | 8 |
| 1843 | HPV | 16 | 3 | 16 | B*2705 | AQIFNKPY | 1939 | 100.00 | 8 |
| 1844 | HPV | 16 | 3 | 16 | B*2705 | QRAQGHNN | 1940 | 100.00 | 8 |
| 1845 | HPV | 16 | 3 | 16 | B*2705 | TRSTNMSL | 1941 | 2000.00 | 8 |
| 1846 | HPV | 16 | 3 | 16 | B*3901 | RHGEEYDL | 1942 | 180.00 | 8 |
| 1847 | HPV | 16 | 3 | 16 | B*2705 | LQFIFQLC | 1943 | 100.00 | 8 |
| 1848 | HPV | 16 | 3 | 16 | B*2705 | FQLCKITL | 1944 | 200.00 | 8 |
| 1849 | HPV | 16 | 3 | 16 | B*5102 | TADVMTYI | 1945 | 110.00 | 8 |
| 1850 | HPV | 16 | 3 | 16 | B*5102 | QPPPGGTL | 1946 | 110.00 | 8 |
| 1851 | HPV | 16 | 3 | 16 | B*2705 | YRFVTQAI | 1947 | 3000.00 | 8 |
| 1852 | HPV | 16 | 3 | 16 | B*2705 | TQAIACQK | 1948 | 200.00 | 8 |
| 1853 | HPV | 16 | 3 | 16 | B*3501 | APKEDDPL | 1949 | 180.00 | 8 |
| 1854 | HPV | 16 | 3 | 16 | B*5102 | FPLGRKFL | 1950 | 660.00 | 8 |
| 1855 | HPV | 16 | 3 | 16 | B*2705 | GRKFLLQA | 1951 | 200.00 | 8 |
| 1856 | HPV | 16 | 3 | 16 | B*2705 | LQAGLKAK | 1952 | 200.00 | 8 |
| 1857 | HPV | 16 | 3 | 16 | B8 | KAKPKFTL | 1953 | 160.00 | 8 |
| 1858 | HPV | 16 | 3 | 16 | B*2705 | KRKATPTT | 1954 | 600.00 | 8 |
| 1859 | HPV | 16 | 3 | 16 | B*2705 | MQVTFIYIL | 1956 | 200.00 | 9 |
| 1860 | HPV | 16 | 3 | 16 | B*3901 | YHIFFQMSL | 1957 | 180.00 | 9 |
| 1861 | HPV | 16 | 3 | 16 | Cw*0401 | IFFQMSLWL | 1958 | 220.00 | 9 |
| 1862 | HPV | 16 | 3 | 16 | Cw*0401 | LPSEATVYL | 1959 | 105.60 | 9 |
| 1863 | HPV | 16 | 3 | 16 | B*5102 | LPSEATVYL | 1959 | 133.10 | 9 |
| 1864 | HPV | 16 | 3 | 16 | B*5103 | EATVYLPPV | 1960 | 110.00 | 9 |
| 1865 | HPV | 16 | 3 | 16 | B*5102 | EATVYLPPV | 1960 | 100.00 | 9 |
| 1866 | HPV | 16 | 3 | 16 | B*5102 | LPPVPVSKV | 1961 | 400.00 | 9 |
| 1867 | HPV | 16 | 3 | 16 | B*2705 | ARTNIYYHA | 1962 | 200.00 | 9 |
| 1868 | HPV | 16 | 3 | 16 | A24 | YYHAGTSRL | 1963 | 200.00 | 9 |
| 1869 | HPV | 16 | 3 | 16 | Cw*0401 | YYHAGTSRL | 1963 | 300.00 | 9 |
| 1870 | HPV | 16 | 3 | 16 | B*5102 | KPNNNKILV | 1964 | 242.00 | 9 |
| 1871 | HPV | 16 | 3 | 16 | Cw*0301 | ILVPKVSGL | 1965 | 120.00 | 9 |
| 1872 | HPV | 16 | 3 | 16 | B*3501 | VPKVSGLQY | 1966 | 120.00 | 9 |
| 1873 | HPV | 16 | 3 | 16 | A*0201 | GLQYRVFRI | 1967 | 139.17 | 9 |
| 1874 | HPV | 16 | 3 | 16 | A24 | QYRVFRIHL | 1968 | 200.00 | 9 |
| 1875 | HPV | 16 | 3 | 16 | Cw*0401 | QYRVFRIHL | 1968 | 220.00 | 9 |
| 1876 | HPV | 16 | 3 | 16 | B*2705 | FRIHLPDPN | 1969 | 200.00 | 9 |
| 1877 | HPV | 16 | 3 | 16 | Cw*0401 | KFGFPDTSF | 1970 | 110.00 | 9 |
| 1878 | HPV | 16 | 3 | 16 | A24 | FYNPDTQRL | 1971 | 432.00 | 9 |
| 1879 | HPV | 16 | 3 | 16 | Cw*0401 | FYNPDTQRL | 1971 | 240.00 | 9 |
| 1880 | HPV | 16 | 3 | 16 | B60 | VEVGRGQPL | 1972 | 320.00 | 9 |
| 1881 | HPV | 16 | 3 | 16 | B*5103 | SAYAANAGV | 1973 | 330.00 | 9 |
| 1882 | HPV | 16 | 3 | 16 | B*5102 | SAYAANAGV | 1973 | 550.00 | 9 |
| 1883 | HPV | 16 | 3 | 16 | B*5102 | AGVDNRECI | 1974 | 290.40 | 9 |
| 1884 | HPV | 16 | 3 | 16 | B*2702 | NRECISMDY | 1975 | 200.00 | 9 |
| 1885 | HPV | 16 | 3 | 16 | B*2705 | NRECISMDY | 1975 | 1000.00 | 9 |
| 1886 | HPV | 16 | 3 | 16 | A24 | DYKQTQLCL | 1976 | 200.00 | 9 |
| 1887 | HPV | 16 | 3 | 16 | Cw*0401 | DYKQTQLCL | 1976 | 240.00 | 9 |
| 1888 | HPV | 16 | 3 | 16 | B*2705 | TQLCLIGCK | 1977 | 200.00 | 9 |
| 1889 | HPV | 16 | 3 | 16 | B*3701 | GDCPPLELI | 1978 | 200.00 | 9 |
| 1890 | HPV | 16 | 3 | 16 | B*5102 | VPLDICTSI | 1979 | 1200.00 | 9 |

TABLE 7-continued

| No | Species | Strain type | Frame | ORF | HLA | Seq | Seq ID No. | Score | Length |
|---|---|---|---|---|---|---|---|---|---|
| 1891 | HPV | 16 | 3 | 16 | Cw*0301 | CKYPDYIKM | 1980 | 125.00 | 9 |
| 1892 | HPV | 16 | 3 | 16 | Cw*0401 | FFYLRREQM | 1981 | 110.00 | 9 |
| 1893 | HPV | 16 | 3 | 16 | A24 | FYLRREQMF | 1982 | 180.00 | 9 |
| 1894 | HPV | 16 | 3 | 16 | Cw*0401 | FYLRREQMF | 1982 | 110.00 | 9 |
| 1895 | HPV | 16 | 3 | 16 | A*0201 | YLRREQMFV | 1983 | 133.73 | 9 |
| 1896 | HPV | 16 | 3 | 16 | B*2705 | LRREQMFVR | 1984 | 1000.00 | 9 |
| 1897 | HPV | 16 | 3 | 16 | B*2705 | RREQMFVRH | 1985 | 600.00 | 9 |
| 1898 | HPV | 16 | 3 | 16 | B60 | REQMFVRHL | 1986 | 160.00 | 9 |
| 1899 | HPV | 16 | 3 | 16 | B*2705 | NRAGTVGEN | 1987 | 200.00 | 9 |
| 1900 | HPV | 16 | 3 | 16 | E*5103 | RAGTVGENV | 1988 | 121.00 | 9 |
| 1901 | HPV | 16 | 3 | 16 | B*5102 | RAGTVGENV | 1988 | 133.10 | 9 |
| 1902 | HPV | 16 | 3 | 16 | A68.1 | NVPDDLYIK | 1989 | 120.00 | 9 |
| 1903 | HPV | 16 | 3 | 16 | Cw*0401 | YFPTPSGSM | 1990 | 110.00 | 9 |
| 1904 | HPV | 16 | 3 | 16 | B*5102 | FPTPSGSMV | 1991 | 400.00 | 9 |
| 1905 | HPV | 16 | 3 | 16 | B*5103 | RAQGHNNGI | 1992 | 110.00 | 9 |
| 1906 | HPV | 16 | 3 | 16 | B*5102 | RAQGHNNGI | 1992 | 242.00 | 9 |
| 1907 | HPV | 16 | 3 | 16 | A68.1 | FVTVVDTTR | 1993 | 300.00 | 9 |
| 1908 | HPV | 16 | 3 | 16 | B*2705 | TRSTNMSLC | 1994 | 200.00 | 9 |
| 1909 | HPV | 16 | 3 | 16 | B*2705 | LRHGEEYDL | 1995 | 2000.00 | 9 |
| 1910 | HPV | 16 | 3 | 16 | B*2705 | LQFIFQLCK | 1996 | 1000.00 | 9 |
| 1911 | HPV | 16 | 3 | 16 | Cw*0401 | IFQLCKITL | 1997 | 200.00 | 9 |
| 1912 | HPV | 16 | 3 | 16 | B*2705 | LQPPPGGTL | 1998 | 200.00 | 9 |
| 1913 | HPV | 16 | 3 | 16 | B*2702 | YRFVTQAIA | 1999 | 100.00 | 9 |
| 1914 | HPV | 16 | 3 | 16 | B*2705 | YRFVTQAIA | 1999 | 1000.00 | 9 |
| 1915 | HPV | 16 | 3 | 16 | A24 | KYTFWEVNL | 2000 | 400.00 | 9 |
| 1916 | HPV | 16 | 3 | 16 | Cw*0401 | KYTFWEVNL | 2000 | 200.00 | 9 |
| 1917 | HPV | 16 | 3 | 16 | Cw*0401 | KFSADLDQF | 2001 | 200.00 | 9 |
| 1918 | HPV | 16 | 3 | 16 | B62 | DQFPLGRKF | 2002 | 192.00 | 9 |
| 1919 | HPV | 16 | 3 | 16 | Cw*0401 | QFPLGRKFL | 2003 | 200.00 | 9 |
| 1920 | HPV | 16 | 3 | 16 | B*5102 | FPLGRKFLL | 2004 | 660.00 | 9 |
| 1921 | HPV | 16 | 3 | 16 | B*2705 | KRKATPTTS | 2005 | 600.00 | 9 |
| 1922 | HPV | 16 | 3 | 16 | B8 | TAKRKKRKL | 2006 | 320.00 | 9 |
| 1923 | HPV | 16 | 3 | 16 | Cw*0401 | VYHIFFQMSL | 2007 | 330.00 | 10 |
| 1924 | HPV | 16 | 3 | 16 | A24 | VYHIFFQMSL | 2007 | 200.00 | 10 |
| 1925 | HPV | 16 | 3 | 16 | A*0201 | SLWLPSEATV | 2008 | 577.28 | 10 |
| 1926 | HPV | 16 | 3 | 16 | A*0201 | WLPSEATVYL | 2009 | 540.47 | 10 |
| 1927 | HPV | 16 | 3 | 16 | A*0201 | YLPPVPVSKV | 2010 | 735.86 | 10 |
| 1928 | HPV | 16 | 3 | 16 | B*5102 | LPPVPVSKVV | 2011 | 242.00 | 10 |
| 1929 | HPV | 16 | 3 | 16 | B*5201 | LPPVPVSKVV | 2011 | 435.60 | 10 |
| 1930 | HPV | 16 | 3 | 16 | A68.1 | VVSTDEYVAR | 2012 | 200.00 | 10 |
| 1931 | HPV | 16 | 3 | 16 | Cw*0401 | IYYHAGTSRL | 2013 | 200.00 | 10 |
| 1932 | HPV | 16 | 3 | 16 | A24 | IYYHAGTSRL | 2013 | 200.00 | 10 |
| 1933 | HPV | 16 | 3 | 16 | Cw*0401 | YYHAGTSRLL | 2014 | 360.00 | 10 |
| 1934 | HPV | 16 | 3 | 16 | A24 | YYHAGTSRLL | 2014 | 200.00 | 10 |
| 1935 | HPV | 16 | 3 | 16 | B*5102 | HAGTSRLLAV | 2015 | 110.00 | 10 |
| 1936 | HPV | 16 | 3 | 16 | B*5103 | HAGTSRLLAV | 2015 | 121.00 | 10 |
| 1937 | HPV | 16 | 3 | 16 | B*2702 | SRLLAVGHPY | 2016 | 200.00 | 10 |
| 1938 | HPV | 16 | 3 | 16 | B*2705 | SRLLAVGHPY | 2016 | 1000.00 | 10 |
| 1939 | HPV | 16 | 3 | 16 | B*5102 | LAVGHPYFPI | 2017 | 660.00 | 10 |
| 1940 | HPV | 16 | 3 | 16 | B*5103 | LAVGHPYFPI | 2017 | 110.00 | 10 |
| 1941 | HPV | 16 | 3 | 16 | A68.1 | AVGHPYFPIK | 2018 | 240.00 | 10 |
| 1942 | HPV | 16 | 3 | 16 | A*0205 | KILVPKVSGL | 2019 | 126.00 | 10 |
| 1943 | HPV | 16 | 3 | 16 | B*5102 | SGLQYRVFRI | 2020 | 528.00 | 10 |
| 1944 | HPV | 16 | 3 | 16 | B*2705 | LQYRVFRIHL | 2021 | 1000.00 | 10 |
| 1945 | HPV | 16 | 3 | 16 | B*2705 | FRIHLPDPNK | 2022 | 2000.00 | 10 |
| 1946 | HPV | 16 | 3 | 16 | Cw*0401 | SFYNPDTQRL | 2023 | 200.00 | 10 |
| 1947 | HPV | 16 | 3 | 16 | B*2705 | QRLVWACVGV | 2024 | 600.00 | 10 |
| 1948 | HPV | 16 | 3 | 16 | B*2705 | GRGQPLGVGI | 2025 | 600.00 | 10 |
| 1949 | HPV | 16 | 3 | 16 | B*5102 | NAGVDNRECI | 2026 | 242.00 | 10 |
| 1950 | HPV | 16 | 3 | 16 | B*5103 | NAGVDNRECI | 2026 | 121.00 | 10 |
| 1951 | HPV | 16 | 3 | 16 | B*2705 | NRECISMDYK | 2027 | 2000.00 | 10 |
| 1952 | HPV | 16 | 3 | 16 | B7 | NPGDCPPLEL | 2028 | 120.00 | 10 |
| 1953 | HPV | 16 | 3 | 16 | B*5102 | NPGDCPPLEL | 2028 | 100.00 | 10 |
| 1954 | HPV | 16 | 3 | 16 | B*5102 | CPPLELINTV | 2029 | 266.20 | 10 |
| 1955 | HPV | 16 | 3 | 16 | B*5102 | PPLELINTVI | 2030 | 145.20 | 10 |
| 1956 | HPV | 16 | 3 | 16 | Cw*0401 | GFGAMDFTTL | 2031 | 200.00 | 10 |
| 1957 | HPV | 16 | 3 | 16 | B*2705 | LQANKSEVPL | 2032 | 200.00 | 10 |
| 1958 | HPV | 16 | 3 | 16 | A1 | VSEPYGDSLF | 2033 | 135.00 | 10 |
| 1959 | HPV | 16 | 3 | 16 | Cw*0401 | LFFYLRREQM | 2034 | 110.00 | 10 |
| 1960 | HPV | 16 | 3 | 16 | Cw*0401 | FFYLRREQMF | 2035 | 110.00 | 10 |
| 1961 | HPV | 16 | 3 | 16 | B*2705 | LRREQMFVRH | 2036 | 200.00 | 10 |
| 1962 | HPV | 16 | 3 | 16 | B*2705 | RREQMFVRHL | 2037 | 1800.00 | 10 |
| 1963 | HPV | 16 | 3 | 16 | B*2705 | QMFVRHLFNR | 2038 | 125.00 | 10 |
| 1964 | HPV | 16 | 3 | 16 | B*2705 | VRHLFNRAGT | 2039 | 200.00 | 10 |
| 1965 | HPV | 16 | 3 | 16 | B*2705 | NRAGTVGENV | 2040 | 600.00 | 10 |
| 1966 | HPV | 16 | 3 | 16 | Cw*0401 | NYFPTPSGSM | 2041 | 132.00 | 10 |

TABLE 7-continued

| No | Species | Strain type | Frame | ORF | HLA | Seq | Seq ID No. | Score | Length |
|---|---|---|---|---|---|---|---|---|---|
| 1967 | HPV | 16 | 3 | 16 | B*2705 | AQIFNKPYWL | 2042 | 200.00 | 10 |
| 1968 | HPV | 16 | 3 | 16 | B*2705 | QRAQGHNNGI | 2043 | 600.00 | 10 |
| 1969 | HPV | 16 | 3 | 16 | B*2705 | TRSTNMSLCA | 2044 | 200.00 | 10 |
| 1970 | HPV | 16 | 3 | 16 | B*2705 | KEYLRHGEEY | 2045 | 225.00 | 10 |
| 1971 | HPV | 16 | 3 | 16 | Cw*0401 | EYDLQFIFQL | 2046 | 600.00 | 10 |
| 1972 | HPV | 16 | 3 | 16 | A24 | EYDLQFIFQL | 2046 | 200.00 | 10 |
| 1973 | HPV | 16 | 3 | 16 | B*2705 | LQFIFQLCKI | 2047 | 300.00 | 10 |
| 1974 | HPV | 16 | 3 | 16 | A*0201 | TLTADVMTYI | 2048 | 131.97 | 10 |
| 1975 | HPV | 16 | 3 | 16 | A*0201 | TILEDWNFGL | 2049 | 258.44 | 10 |
| 1976 | HPV | 16 | 3 | 16 | B*2702 | YRFVTQAIAC | 2050 | 100.00 | 10 |
| 1977 | HPV | 16 | 3 | 16 | B*2705 | YRFVTQAIAC | 2050 | 1000.00 | 10 |
| 1978 | HPV | 16 | 3 | 16 | A68.1 | FVTQAIACQK | 2051 | 120.00 | 10 |
| 1979 | HPV | 16 | 3 | 16 | B*2705 | CQKHTPPAPK | 2052 | 200.00 | 10 |
| 1980 | HPV | 16 | 3 | 16 | Cw*0401 | QFPLGRKFLL | 2053 | 220.00 | 10 |
| 1981 | HPV | 16 | 3 | 16 | B*2705 | GRKFLLQAGL | 2054 | 2000.00 | 10 |
| 1982 | HPV | 16 | 3 | 16 | B*2705 | KRKATPTTSS | 2055 | 600.00 | 10 |
| 1983 | HPV | 16 | 3 | 17 | B*2705 | KLYVCLYV | 2154 | 135.00 | 8 |
| 1984 | HPV | 16 | 3 | 17 | B*2705 | CLYVWYNK | 2155 | 150.00 | 8 |
| 1985 | HPV | 16 | 3 | 17 | A3 | CLYVLVNIK | 2156 | 300.00 | 9 |
| 1986 | HPV | 16 | 3 | 17 | B*2705 | CLYVLVNIK | 2156 | 150.00 | 9 |
| 1987 | HPV | 16 | 3 | 17 | A24 | LYVLVNIKL | 2157 | 462.00 | 9 |
| 1988 | HPV | 16 | 3 | 17 | Cw*0401 | LYVLVNIKL | 2157 | 220.00 | 9 |
| 1989 | HPV | 16 | 3 | 17 | A*0201 | VLVNIKLYV | 2158 | 650.31 | 9 |
| 1990 | HPV | 16 | 3 | 17 | Cw*0301 | VNIKLYVCL | 2159 | 100.00 | 9 |
| 1991 | HPV | 16 | 3 | 17 | B*2705 | CLYVLVNIKL | 2160 | 150.00 | 10 |
| 1992 | HPV | 16 | 3 | 17 | A*0201 | YVLVNIKLYV | 2161 | 569.69 | 10 |
| 1993 | HPV | 16 | 3 | 17 | B*2705 | KLYVCLYVWY | 2162 | 225.00 | 10 |
| 1994 | HPV | 16 | 3 | 17 | A68.1 | YVCLYVWYNK | 2163 | 120.00 | 10 |
| 1995 | HPV | 16 | 3 | 17 | A*0201 | CLYVWYNKHV | 2164 | 222.57 | 10 |
| 1996 | HPV | 16 | 3 | 17 | Cw*0401 | WYNKHVCMCF | 2165 | 100.00 | 10 |
| 1997 | HPV | 16 | 3 | 17 | A24 | WYNKHVCMCF | 2165 | 210.00 | 10 |
| 1998 | HPV | 16 | 3 | 18 | Cw*0301 | FGLHIYKQL | 2166 | 120.00 | 9 |
| 1999 | HPV | 16 | 3 | 18 | B*5102 | FGLHIYKQL | 2166 | 145.20 | 9 |
| 2000 | HPV | 16 | 3 | 18 | A68.1 | KVSHTLFICK | 2167 | 120.00 | 10 |
| 2001 | HPV | 16 | 3 | 18 | B*2705 | VQTDFGLHIY | 2168 | 100.00 | 10 |
| 2002 | HPV | 16 | 3 | 18 | B62 | VQTDFGLHIY | 2168 | 176.00 | 10 |
| 2003 | HPV | 16 | 3 | 18 | A1 | QTDFGLHIYK | 2169 | 125.00 | 10 |
| 2004 | HPV | 16 | 3 | 18 | Cw*0401 | DFGLHIYKQL | 2170 | 200.00 | 10 |
| 2005 | HPV | 16 | 3 | 18 | B*5102 | FGLHIYKQLI | 2171 | 580.80 | 10 |
| 2006 | HPV | 16 | 4 | 1 | B*5102 | LGYKPISI | 2172 | 484.00 | 8 |
| 2007 | HPV | 16 | 4 | 1 | B*5201 | LGYKPISIF | 2173 | 225.00 | 9 |
| 2008 | HPV | 16 | 4 | 2 | B*5102 | GPNQPLCI | 2174 | 440.00 | 8 |
| 2009 | HPV | 16 | 4 | 2 | B*5102 | QPLCIWII | 2175 | 1200.00 | 8 |
| 2010 | HPV | 16 | 4 | 2 | A24 | TYTGPNQPL | 2176 | 240.00 | 9 |
| 2011 | HPV | 16 | 4 | 2 | Cw*0401 | TYTGPNQPL | 2176 | 200.00 | 9 |
| 2012 | HPV | 16 | 4 | 2 | B*5201 | NQPLCIWII | 2177 | 240.00 | 9 |
| 2013 | HPV | 16 | 4 | 2 | B*5102 | GPNQPLCIWI | 2178 | 440.00 | 10 |
| 2014 | HPV | 16 | 4 | 2 | B*2705 | NQPLCIWIIK | 2179 | 200.00 | 10 |
| 2015 | HPV | 16 | 4 | 3 | A*0201 | MVNVYVFV | 2180 | 130.88 | 9 |
| 2016 | HPV | 16 | 4 | 3 | A*0201 | NMVNVYVVFV | 2181 | 635.43 | 10 |
| 2017 | HPV | 16 | 4 | 4 | B*2705 | HQKELLYL | 2182 | 200.00 | 8 |
| 2018 | HPV | 16 | 4 | 4 | B*2705 | LQEYNLIK | 2183 | 200.00 | 8 |
| 2019 | HPV | 16 | 4 | 4 | B*2705 | KEYCMHHQK | 2184 | 450.00 | 9 |
| 2020 | HPV | 16 | 4 | 4 | B*3901 | HHQKELLYL | 2185 | 135.00 | 9 |
| 2021 | HPV | 16 | 4 | 4 | A*0201 | LLYLQEYNL | 2186 | 116.21 | 9 |
| 2022 | HPV | 16 | 4 | 4 | B*2705 | LLYLQEYNL | 2186 | 150.00 | 9 |
| 2023 | HPV | 16 | 4 | 4 | A3 | YLQEYNLIK | 2187 | 180.00 | 9 |
| 2024 | HPV | 16 | 4 | 4 | Cw*0401 | EYCMHHQKEL | 2188 | 220.00 | 10 |
| 2025 | HPV | 16 | 4 | 4 | A24 | EYCMHHQKEL | 2188 | 220.00 | 10 |
| 2026 | HPV | 16 | 4 | 4 | B*3901 | MHHQKELLYL | 2189 | 135.00 | 10 |
| 2027 | HPV | 16 | 4 | 4 | B*0201 | YLQEYNLIKM | 2190 | 215.50 | 10 |
| 2028 | HPV | 16 | 4 | 6 | B*2705 | QLYPKSQDL | 2191 | 150.00 | 9 |
| 2029 | HPV | 16 | 4 | 6 | Cw*0301 | QLYPKSQDL | 2191 | 120.00 | 9 |
| 2030 | HPV | 16 | 4 | 6 | B*5102 | YPKSQDLEL | 2192 | 110.00 | 9 |
| 2031 | HPV | 16 | 4 | 6 | B*2705 | KQLYPKSQDL | 2193 | 600.00 | 10 |
| 2032 | HPV | 16 | 4 | 6 | Cw*0401 | LYPKSQDLEL | 2194 | 200.00 | 10 |
| 2033 | HPV | 16 | 4 | 6 | A24 | LYPKSQDLEL | 2194 | 330.00 | 10 |
| 2034 | HPV | 16 | 4 | 6 | B*3501 | YPKSQDLELY | 2195 | 180.00 | 10 |
| 2035 | HPV | 16 | 4 | 9 | B*2705 | GEWKVQML | 2196 | 150.00 | 8 |
| 2036 | HPV | 16 | 4 | 9 | A*0201 | LIHLGEWKV | 2197 | 121.93 | 9 |
| 2037 | HPV | 16 | 4 | 10 | B*5102 | KGVLQEQV | 2198 | 159.72 | 8 |
| 2038 | HPV | 16 | 4 | 11 | B*2705 | VRLYPTLF | 2199 | 1000.00 | 8 |
| 2039 | HPV | 16 | 4 | 11 | B*5102 | YPTLFQFL | 2200 | 242.00 | 8 |
| 2040 | HPV | 16 | 4 | 11 | B*2705 | FQFLTHQK | 2201 | 1000.00 | 8 |
| 2041 | HPV | 16 | 4 | 11 | B*2705 | HQKIHPYF | 2202 | 100.00 | 8 |
| 2042 | HPV | 16 | 4 | 11 | B*5102 | HPYFHIVI | 2203 | 2200.00 | 8 |

TABLE 7-continued

| No | Species | Strain type | Frame | ORF | HLA | Seq | Seq ID No. | Score | Length |
|---|---|---|---|---|---|---|---|---|---|
| 2043 | HPV | 16 | 4 | 11 | B*5102 | FPMEYTQCV | 2204 | 532.40 | 9 |
| 2044 | HPV | 16 | 4 | 11 | B*2705 | MEYTQCVRL | 2205 | 150.00 | 9 |
| 2045 | HPV | 16 | 4 | 11 | B60 | MEYTQCVRL | 2205 | 352.00 | 9 |
| 2046 | HPV | 16 | 4 | 11 | Cw*0301 | QCVRLYPTL | 2206 | 180.00 | 9 |
| 2047 | HPV | 16 | 4 | 11 | B*2705 | RLYPTLFQF | 2207 | 225.00 | 9 |
| 2048 | HPV | 16 | 4 | 11 | A24 | LYPTLFQFL | 2208 | 518.40 | 9 |
| 2049 | HPV | 16 | 4 | 11 | Cw*0401 | LYPTLFQFL | 2208 | 200.00 | 9 |
| 2050 | HPV | 16 | 4 | 11 | B*2705 | FQFLTHQKI | 2209 | 300.00 | 9 |
| 2051 | HPV | 16 | 4 | 11 | B*5102 | FQFLTHQKI | 2209 | 106.48 | 9 |
| 2052 | HPV | 16 | 4 | 11 | B*5201 | HPYFHIVIF | 2210 | 125.00 | 9 |
| 2053 | HPV | 16 | 4 | 11 | B*2705 | TQCVRLYPTL | 2211 | 200.00 | 10 |
| 2054 | HPV | 16 | 4 | 11 | B*2702 | VRLYPTLFQF | 2212 | 200.00 | 10 |
| 2055 | HPV | 16 | 4 | 11 | B*2705 | VRLYPTLFQF | 2212 | 1000.00 | 10 |
| 2056 | HPV | 16 | 4 | 11 | A*0201 | RLYPTLFQFL | 2213 | 714.36 | 10 |
| 2057 | HPV | 16 | 4 | 11 | B*2705 | RLYPTLFQFL | 2213 | 450.00 | 10 |
| 2058 | HPV | 16 | 4 | 11 | Cw*0301 | RLYPTLFQFL | 2213 | 600.00 | 10 |
| 2059 | HPV | 16 | 4 | 11 | A3 | TLFQFLTHQK | 2214 | 100.00 | 10 |
| 2060 | HPV | 16 | 4 | 11 | B*2705 | TLFQFLTHQK | 2214 | 150.00 | 10 |
| 2061 | HPV | 16 | 4 | 11 | B*5102 | HPYFHIVIFV | 2215 | 1000.00 | 10 |
| 2062 | HPV | 16 | 4 | 11 | B*5103 | HPYFHIVIFV | 2215 | 120.00 | 10 |
| 2063 | HPV | 16 | 4 | 11 | B*5201 | HPYFHIVIFV | 2215 | 150.00 | 10 |
| 2064 | HPV | 16 | 4 | 12 | B*5102 | LPVCMFYKV | 2216 | 1200.00 | 9 |
| 2065 | HPV | 16 | 4 | 13 | A*0201 | LLLSTIVIPI | 2217 | 150.93 | 10 |
| 2066 | HPV | 16 | 4 | 14 | B*5102 | NAVRIGAL | 2218 | 165.00 | 8 |
| 2067 | HPV | 16 | 4 | 14 | B*2705 | VRIGALST | 2219 | 200.00 | 8 |
| 2068 | HPV | 16 | 4 | 14 | B*5102 | GALSTESL | 2220 | 165.00 | 8 |
| 2069 | HPV | 16 | 4 | 14 | B*5102 | FPVSGSDL | 2221 | 660.00 | 8 |
| 2070 | HPV | 16 | 4 | 14 | B*2705 | GRWIVVCV | 2222 | 3000.00 | 8 |
| 2071 | HPV | 16 | 4 | 14 | B*5102 | VPKATALV | 2223 | 110.00 | 8 |
| 2072 | HPV | 16 | 4 | 14 | B*5102 | KATALVWV | 2224 | 100.00 | 8 |
| 2073 | HPV | 16 | 4 | 14 | B*5102 | LAKCCLII | 2225 | 100.00 | 8 |
| 2074 | HPV | 16 | 4 | 14 | Cw*0401 | GFPVSGSDL | 2226 | 200.00 | 9 |
| 2075 | HPV | 16 | 4 | 14 | B*5801 | VSGSDLGRW | 2227 | 105.60 | 9 |
| 2076 | HPV | 16 | 4 | 14 | B*2705 | GRWIVVCVS | 2228 | 1000.00 | 9 |
| 2077 | HPV | 16 | 4 | 14 | A*0201 | WIVVCVSSV | 2229 | 101.18 | 9 |
| 2078 | HPV | 16 | 4 | 14 | A68.1 | VVCVSSVPK | 2230 | 120.00 | 9 |
| 2079 | HPV | 16 | 4 | 14 | Cw*0301 | SSVPKATAL | 2231 | 100.00 | 9 |
| 2080 | HPV | 16 | 4 | 14 | A68.1 | WVAAGWLAK | 2232 | 240.00 | 9 |
| 2081 | HPV | 16 | 4 | 14 | B*5102 | AGWLAKCCL | 2233 | 110.00 | 9 |
| 2082 | HPV | 16 | 4 | 14 | B*2705 | VRIGALSTES | 2234 | 200.00 | 10 |
| 2083 | HPV | 16 | 4 | 14 | A*0201 | NLVVWQGFPV | 2235 | 403.40 | 10 |
| 2084 | HPV | 16 | 4 | 14 | B*5102 | QGFPVSGSDL | 2236 | 100.00 | 10 |
| 2085 | HPV | 16 | 4 | 14 | B*2705 | GRWIVVCVSS | 2237 | 1000.00 | 10 |
| 2086 | HPV | 16 | 4 | 14 | A68.1 | IVVCVSSVPK | 2238 | 240.00 | 10 |
| 2087 | HPV | 16 | 4 | 14 | B*5102 | VPKATALVWV | 2239 | 100.00 | 10 |
| 2088 | HPV | 16 | 4 | 14 | B*5102 | AGWLAKCCLI | 2240 | 440.00 | 10 |
| 2089 | HPV | 16 | 4 | 15 | B*5102 | TPTSTTIL | 2241 | 121.00 | 8 |
| 2090 | HPV | 16 | 4 | 15 | B*5801 | TSTTILTTW | 2242 | 158.40 | 9 |
| 2091 | HPV | 16 | 4 | 15 | A*0201 | ILTTWCFSL | 2243 | 210.63 | 9 |
| 2092 | HPV | 16 | 4 | 15 | B*5102 | TATTPTSTTI | 2244 | 266.20 | 10 |
| 2093 | HPV | 16 | 4 | 15 | B*5103 | TATTPTSTTI | 2244 | 121.00 | 10 |
| 2094 | HPV | 16 | 4 | 15 | Cw*0401 | CFSLMAPFYL | 2245 | 220.00 | 10 |
| 2095 | HPV | 16 | 4 | 16 | Cw*0401 | HFSIAIPAVF | 2246 | 120.00 | 10 |
| 2096 | HPV | 16 | 4 | 18 | B*5103 | SACPAGPSI | 2247 | 110.00 | 9 |
| 2097 | HPV | 16 | 4 | 18 | B*5102 | SACPAGPSI | 2247 | 200.00 | 9 |
| 2098 | HPV | 16 | 4 | 19 | B*5102 | APVGPETL | 2248 | 330.00 | 8 |
| 2099 | HPV | 16 | 4 | 19 | A*0201 | CITVVTFWV | 2249 | 305.07 | 9 |
| 2100 | HPV | 16 | 4 | 2 | B*2705 | MQPNSVEATK | 2250 | 200.00 | 10 |
| 2101 | HPV | 16 | 4 | 2 | B*5801 | NSVEATKWAW | 2251 | 160.00 | 10 |
| 2102 | HPV | 16 | 4 | 2 | A68.1 | SVEATKWAWR | 2252 | 200.00 | 10 |
| 2103 | HPV | 16 | 4 | 3 | B*5102 | LGYKPISI | 2172 | 484.00 | 8 |
| 2104 | HPV | 16 | 4 | 3 | B*5201 | LGYKPISIF | 2173 | 225.00 | 9 |
| 2105 | HPV | 16 | 4 | 8 | B*2705 | IRAYNLRY | 2253 | 300.00 | 8 |
| 2106 | HPV | 16 | 4 | 8 | B*2705 | RRQVDSGL | 2254 | 6000.00 | 8 |
| 2107 | HPV | 16 | 4 | 8 | B*2705 | TRQPKRHL | 2255 | 2000.00 | 8 |
| 2108 | HPV | 16 | 4 | 8 | B*2705 | RQPKRHLK | 2256 | 600.00 | 8 |
| 2109 | HPV | 16 | 4 | 8 | B*2705 | KRHLKKNM | 2257 | 1800.00 | 8 |
| 2110 | HPV | 16 | 4 | 8 | A24 | IYVCACNIF | 2258 | 180.00 | 9 |
| 2111 | HPV | 16 | 4 | 8 | Cw*0401 | IYVCACNIF | 2258 | 110.00 | 9 |
| 2112 | HPV | 16 | 4 | 8 | B14 | LRYWDRRQV | 2259 | 100.00 | 9 |
| 2113 | HPV | 16 | 4 | 8 | B*2705 | LRYWDRRQV | 2259 | 900.00 | 9 |
| 2114 | HPV | 16 | 4 | 8 | B*2705 | DRRQVDSGL | 2260 | 200.00 | 9 |
| 2115 | HPV | 16 | 4 | 8 | B*2705 | RRQVDSGLT | 2261 | 600.00 | 9 |
| 2116 | HPV | 16 | 4 | 8 | B*2705 | RQVDSGLTR | 2262 | 300.00 | 9 |
| 2117 | HPV | 16 | 4 | 8 | B*2705 | TRQPKRHLK | 2263 | 2000.00 | 9 |
| 2118 | HPV | 16 | 4 | 8 | B*2705 | RQPKRHLKK | 2264 | 600.00 | 9 |

TABLE 7-continued

| No | Species | Strain type | Frame | ORF | HLA | Seq | Seq ID No. | Score | Length |
|---|---|---|---|---|---|---|---|---|---|
| 2119 | HPV | 16 | 4 | 8 | B*2705 | KRHLKKNMV | 2265 | 1800.00 | 9 |
| 2120 | HPV | 16 | 4 | 8 | A*0201 | MVNVYVVFV | 2180 | 130.88 | 9 |
| 2121 | HPV | 16 | 4 | 8 | A68.1 | YVCACNIFIR | 2266 | 200.00 | 10 |
| 2122 | HPV | 16 | 4 | 8 | B*2705 | LRYWDRRQVD | 2267 | 100.00 | 10 |
| 2123 | HPV | 16 | 4 | 8 | B*2705 | RRQVDSGLTR | 2268 | 3000.00 | 10 |
| 2124 | HPV | 16 | 4 | 8 | B*2705 | TRQPKRHLKK | 2269 | 2000.00 | 10 |
| 2125 | HPV | 16 | 4 | 8 | B*3501 | QPKRHLKKNM | 2270 | 120.00 | 10 |
| 2126 | HPV | 16 | 4 | 8 | B*2705 | KRHLKKNMVN | 2271 | 600.00 | 10 |
| 2127 | HPV | 16 | 4 | 8 | B62 | HLKKNMVNVY | 2272 | 132.00 | 10 |
| 2128 | HPV | 16 | 4 | 8 | A*0201 | NMVNVYVVFV | 2181 | 635.43 | 10 |
| 2129 | HPV | 16 | 4 | 10 | B*2705 | HQKELLYL | 2182 | 200.00 | 8 |
| 2130 | HPV | 16 | 4 | 10 | B*2705 | LQEYNLIK | 2183 | 200.00 | 8 |
| 2131 | HPV | 16 | 4 | 10 | B*3901 | HHQKELLYL | 2185 | 135.00 | 9 |
| 2132 | HPV | 16 | 4 | 10 | A*0201 | LLYLQEYNL | 2186 | 116.21 | 9 |
| 2133 | HPV | 16 | 4 | 10 | B*2705 | LLYLQEYNL | 2186 | 150.00 | 9 |
| 2134 | HPV | 16 | 4 | 10 | A3 | YLQEYNLIK | 2187 | 180.00 | 9 |
| 2135 | HPV | 16 | 4 | 10 | B*3901 | MHHQKELLYL | 2189 | 135.00 | 10 |
| 2136 | HPV | 16 | 4 | 10 | A*0201 | YLQEYNLIKM | 2190 | 215.50 | 10 |
| 2137 | HPV | 16 | 4 | 11 | B*2705 | QLYPKSQDL | 2191 | 150.00 | 9 |
| 2138 | HPV | 16 | 4 | 11 | Cw*0301 | QLYPKSQDL | 2191 | 120.00 | 9 |
| 2139 | HPV | 16 | 4 | 11 | B*5102 | YPKSQDLEL | 2192 | 110.00 | 9 |
| 2140 | HPV | 16 | 4 | 11 | B*2705 | KQLYPKSQDL | 2193 | 600.00 | 10 |
| 2141 | HPV | 16 | 4 | 11 | Cw*0401 | LYPKSQDLEL | 2194 | 200.00 | 10 |
| 2142 | HPV | 16 | 4 | 11 | A24 | LYPKSQDLEL | 2194 | 330.00 | 10 |
| 2143 | HPV | 16 | 4 | 11 | B*3501 | YPKSQDLELY | 2195 | 180.00 | 10 |
| 2144 | HPV | 16 | 4 | 12 | Cw*0401 | YYPHLYLHM | 2273 | 110.00 | 9 |
| 2145 | HPV | 16 | 4 | 12 | Cw*0301 | MYYPHLYLHM | 2274 | 125.00 | 10 |
| 2146 | HPV | 16 | 4 | 12 | Cw*0401 | MYYPHLYLHM | 2274 | 132.00 | 10 |
| 2147 | HPV | 16 | 4 | 12 | Cw*0401 | LYLHMQDYHM | 2275 | 110.00 | 10 |
| 2148 | HPV | 16 | 4 | 13 | B*2705 | VRLYPTLF | 2199 | 1000.00 | 8 |
| 2149 | HPV | 16 | 4 | 13 | B*5102 | YPTLFQFL | 2200 | 242.00 | 8 |
| 2150 | HPV | 16 | 4 | 13 | B*2705 | FQFLTHQK | 2201 | 1000.00 | 8 |
| 2151 | HPV | 16 | 4 | 13 | B*2705 | HQKIHPYF | 2202 | 100.00 | 8 |
| 2152 | HPV | 16 | 4 | 13 | B*5102 | HPYFHIVI | 2203 | 2200.00 | 8 |
| 2153 | HPV | 16 | 4 | 13 | B*2705 | MEYTQCVRL | 2205 | 150.00 | 9 |
| 2154 | HPV | 16 | 4 | 13 | B60 | MEYTQCVRL | 2205 | 352.00 | 9 |
| 2155 | HPV | 16 | 4 | 13 | Cw*0301 | QCVRLYPTL | 2206 | 180.00 | 9 |
| 2156 | HPV | 16 | 4 | 13 | B*2705 | RLYPTLFQF | 2207 | 225.00 | 9 |
| 2157 | HPV | 16 | 4 | 13 | A24 | LYPTLFQFL | 2208 | 518.40 | 9 |
| 2158 | HPV | 16 | 4 | 13 | Cw*0401 | LYPTLFQFL | 2208 | 200.00 | 9 |
| 2159 | HPV | 16 | 4 | 13 | B*2705 | FQFLTHQKI | 2209 | 300.00 | 9 |
| 2160 | HPV | 16 | 4 | 13 | B*5102 | FQFLTHQKI | 2209 | 106.48 | 9 |
| 2161 | HPV | 16 | 4 | 13 | B*5201 | HPYFHIVIF | 2210 | 125.00 | 9 |
| 2162 | HPV | 16 | 4 | 13 | B*2705 | TQCVRLYPTL | 2211 | 200.00 | 10 |
| 2163 | HPV | 16 | 4 | 13 | B*2702 | VRLYPTLFQF | 2212 | 200.00 | 10 |
| 2164 | HPV | 16 | 4 | 13 | B*2705 | VRLYPTLFQF | 2212 | 1000.00 | 10 |
| 2165 | HPV | 16 | 4 | 13 | A*0201 | RLYPTLFQFL | 2213 | 714.36 | 10 |
| 2166 | HPV | 16 | 4 | 13 | B*2705 | RLYPTLFQFL | 2213 | 450.00 | 10 |
| 2167 | HPV | 16 | 4 | 13 | Cw*0301 | RLYPTLFQFL | 2213 | 600.00 | 10 |
| 2168 | HPV | 16 | 4 | 13 | A3 | TLFQFLTHQK | 2214 | 100.00 | 10 |
| 2169 | HPV | 16 | 4 | 13 | B*2705 | TLFQFLTHQK | 2214 | 150.00 | 10 |
| 2170 | HPV | 16 | 4 | 13 | B*5102 | HPYFHIVIFV | 2215 | 1000.00 | 10 |
| 2171 | HPV | 16 | 4 | 13 | B*5103 | HPYFHIVIFV | 2215 | 120.00 | 10 |
| 2172 | HPV | 16 | 4 | 13 | B*5201 | HPYFHIVIFV | 2215 | 150.00 | 10 |
| 2173 | HPV | 16 | 4 | 14 | B*5102 | LPVCMFYKV | 2216 | 1200.00 | 9 |
| 2174 | HPV | 16 | 4 | 14 | A*0201 | YLPVCMFYKV | 2276 | 607.88 | 10 |
| 2175 | HPV | 16 | 4 | 15 | B*2705 | LQNVCVAL | 2277 | 200.00 | 8 |
| 2176 | HPV | 16 | 4 | 15 | B*2705 | LQNVCVALL | 2278 | 200.00 | 9 |
| 2177 | HPV | 16 | 4 | 15 | B*5102 | VALLSNNSL | 2279 | 181.50 | 9 |
| 2178 | HPV | 16 | 4 | 15 | A*0201 | VLCVLQNVCV | 2280 | 118.24 | 10 |
| 2179 | HPV | 16 | 4 | 15 | B*5102 | VALLSNNSLL | 2281 | 199.65 | 10 |
| 2180 | HPV | 16 | 4 | 15 | B*2705 | KQTNKKKNYI | 2282 | 180.00 | 10 |
| 2181 | HPV | 16 | 4 | 16 | B*2705 | IRPLCELL | 2283 | 2000.00 | 8 |
| 2182 | HPV | 16 | 4 | 16 | B*5102 | NAVRIGAL | 2218 | 165.00 | 8 |
| 2183 | HPV | 16 | 4 | 16 | B*2705 | VRIGALST | 2219 | 200.00 | 8 |
| 2184 | HPV | 16 | 4 | 16 | B*5102 | GALSTESL | 2220 | 165.00 | 8 |
| 2185 | HPV | 16 | 4 | 16 | B*5102 | FPVSGSDL | 2221 | 660.00 | 8 |
| 2186 | HPV | 16 | 4 | 16 | B*2705 | GRWIVVCV | 2222 | 3000.00 | 8 |
| 2187 | HPV | 16 | 4 | 16 | B*5102 | VPKATALV | 2223 | 110.00 | 8 |
| 2188 | HPV | 16 | 4 | 16 | B*5102 | KATALVWV | 2224 | 100.00 | 8 |
| 2189 | HPV | 16 | 4 | 16 | B*5102 | LAKCCLII | 2225 | 100.00 | 8 |
| 2190 | HPV | 16 | 4 | 16 | A68.1 | VVLLLQLIR | 2284 | 400.00 | 9 |
| 2191 | HPV | 16 | 4 | 16 | B*2705 | IRPLCELLN | 2285 | 200.00 | 9 |
| 2192 | HPV | 16 | 4 | 16 | Cw*0401 | GFPVSGSDL | 2226 | 200.00 | 9 |
| 2193 | HPV | 16 | 4 | 16 | B*5801 | VSGSDLGRW | 2227 | 105.60 | 9 |
| 2194 | HPV | 16 | 4 | 16 | B*2705 | GRWIVVCVS | 2228 | 1000.00 | 9 |

TABLE 7-continued

| No | Species | Strain type | Frame | ORF | HLA | Seq | Seq ID No. | Score | Length |
|---|---|---|---|---|---|---|---|---|---|
| 2195 | HPV | 16 | 4 | 16 | A*0201 | WIVVCVSSV | 2229 | 101.18 | 9 |
| 2196 | HPV | 16 | 4 | 16 | A68.1 | VVCVSSVPK | 2230 | 120.00 | 9 |
| 2197 | HPV | 16 | 4 | 16 | Cw*0301 | SSVPKATAL | 2231 | 100.00 | 9 |
| 2198 | HPV | 16 | 4 | 16 | A68.1 | WVAAGWLAK | 2232 | 240.00 | 9 |
| 2199 | HPV | 16 | 4 | 16 | B*5102 | AGWLAKCCL | 2233 | 110.00 | 9 |
| 2200 | HPV | 16 | 4 | 16 | B*5102 | MGVVLLLQLI | 2286 | 264.00 | 10 |
| 2201 | HPV | 16 | 4 | 16 | A68.1 | GVVLLLQLIR | 2287 | 400.00 | 10 |
| 2202 | HPV | 16 | 4 | 16 | B*2705 | LQLIRPLCEL | 2288 | 200.00 | 10 |
| 2203 | HPV | 16 | 4 | 16 | B*2705 | IRPLCELLNA | 2289 | 200.00 | 10 |
| 2204 | HPV | 16 | 4 | 16 | B*5102 | RPLCELLNAV | 2290 | 600.00 | 10 |
| 2205 | HPV | 16 | 4 | 16 | B*2705 | VRIGALSTES | 2234 | 200.00 | 10 |
| 2206 | HPV | 16 | 4 | 16 | A*0201 | NLVVWQGFPV | 2235 | 403.40 | 10 |
| 2207 | HPV | 16 | 4 | 16 | B*5102 | QGFPVSGSDL | 2236 | 100.00 | 10 |
| 2208 | HPV | 16 | 4 | 16 | B*2705 | GRWIVVCVSS | 2237 | 1000.00 | 10 |
| 2209 | HPV | 16 | 4 | 16 | A68.1 | IVVCVSSVPK | 2238 | 240.00 | 10 |
| 2210 | HPV | 16 | 4 | 16 | B*5102 | VPKATALVWV | 2239 | 100.00 | 10 |
| 2211 | HPV | 16 | 4 | 16 | B*5102 | AGWLAKCCLI | 2240 | 440.00 | 10 |
| 2212 | HPV | 16 | 4 | 17 | B*2705 | SRLTSCNV | 2291 | 600.00 | 8 |
| 2213 | HPV | 16 | 4 | 17 | B*5102 | SPSNCTSTV | 2292 | 266.20 | 9 |
| 2214 | HPV | 16 | 4 | 17 | B*5102 | YPCFFIHPV | 2293 | 440.00 | 9 |
| 2215 | HPV | 16 | 4 | 17 | B*5102 | GAVKYTSRL | 2294 | 363.00 | 9 |
| 2216 | HPV | 16 | 4 | 17 | B*2705 | SRLTSCNVH | 2295 | 200.00 | 9 |
| 2217 | HPV | 16 | 4 | 17 | Cw*0401 | HFSLLYCEL | 2296 | 200.00 | 9 |
| 2218 | HPV | 16 | 4 | 17 | A*0201 | SLLYCELYI | 2297 | 212.31 | 9 |
| 2219 | HPV | 16 | 4 | 17 | A*0201 | LLYCELYIV | 2298 | 356.80 | 9 |
| 2220 | HPV | 16 | 4 | 17 | A*0201 | ALFFDTASV | 2299 | 257.34 | 9 |
| 2221 | HPV | 16 | 4 | 17 | B*2702 | SRLTSCNVHF | 2300 | 200.00 | 10 |
| 2222 | HPV | 16 | 4 | 17 | B*2705 | SRLTSCNVHF | 2300 | 1000.00 | 10 |
| 2223 | HPV | 16 | 4 | 17 | B*3901 | VHFSLLYCEL | 2301 | 180.00 | 10 |
| 2224 | HPV | 16 | 4 | 17 | A*0201 | SLLYCELYIV | 2302 | 242.67 | 10 |
| 2225 | HPV | 16 | 4 | 17 | B*5102 | NALFFDTASV | 2303 | 330.00 | 10 |
| 2226 | HPV | 16 | 4 | 17 | B*5103 | NALFFDTASV | 2303 | 132.00 | 10 |
| 2227 | HPV | 16 | 4 | 18 | B*2705 | FRIYKTYY | 2304 | 1000.00 | 8 |
| 2228 | HPV | 16 | 4 | 18 | B*2705 | YRPLQKFH | 2305 | 200.00 | 8 |
| 2229 | HPV | 16 | 4 | 18 | B*2705 | FRIYKTYYR | 2306 | 1000.00 | 9 |
| 2230 | HPV | 16 | 4 | 18 | A24 | IYKTYYRPL | 2307 | 200.00 | 9 |
| 2231 | HPV | 16 | 4 | 18 | Cw*0401 | IYKTYYRPL | 2307 | 200.00 | 9 |
| 2232 | HPV | 16 | 4 | 18 | B*2705 | KTYYRPLQK | 2308 | 150.00 | 9 |
| 2233 | HPV | 16 | 4 | 18 | A24 | TYYRPLQKF | 2309 | 132.00 | 9 |
| 2234 | HPV | 16 | 4 | 18 | Cw*0401 | TYYRPLQKF | 2309 | 220.00 | 9 |
| 2235 | HPV | 16 | 4 | 18 | Cw*0301 | RIYKTYYRPL | 2310 | 100.00 | 10 |
| 2236 | HPV | 16 | 4 | 18 | B*5801 | KTYYRPLQKF | 2311 | 158.40 | 10 |
| 2237 | HPV | 16 | 4 | 20 | B*2705 | NRSSKVRM | 2312 | 180.00 | 8 |
| 2238 | HPV | 16 | 4 | 20 | B*2705 | VRMSTCVL | 2313 | 2000.00 | 8 |
| 2239 | HPV | 16 | 4 | 20 | B*2705 | NRSVESHL | 2314 | 2000.00 | 8 |
| 2240 | HPV | 16 | 4 | 20 | B*2705 | LQQKVTIL | 2315 | 200.00 | 8 |
| 2241 | HPV | 16 | 4 | 20 | A68.1 | SVPINRSSK | 2316 | 120.00 | 9 |
| 2242 | HPV | 16 | 4 | 20 | B*5102 | VPINRSSKV | 2317 | 1320.00 | 9 |
| 2243 | HPV | 16 | 4 | 20 | B7 | KVRMSTCVL | 2318 | 200.00 | 9 |
| 2244 | HPV | 16 | 4 | 20 | B*2705 | VRMSTCVLC | 2319 | 200.00 | 9 |
| 2245 | HPV | 16 | 4 | 20 | A68.1 | SVESHLQQK | 2320 | 120.00 | 9 |
| 2246 | HPV | 16 | 4 | 20 | A68.1 | HTIPSVPINR | 2321 | 150.00 | 10 |
| 2247 | HPV | 16 | 4 | 20 | B*2705 | NRSSKVRMST | 2322 | 200.00 | 10 |
| 2248 | HPV | 16 | 4 | 20 | B*2705 | VRMSTCVLCT | 2323 | 200.00 | 10 |
| 2249 | HPV | 16 | 4 | 20 | B*3901 | SHLQQKVTIL | 2324 | 270.00 | 10 |
| 2250 | HPV | 16 | 4 | 21 | B*5102 | AGFLYVFL | 2325 | 110.00 | 8 |
| 2251 | HPV | 16 | 4 | 21 | B*2705 | DRSTDPLY | 2326 | 100.00 | 8 |
| 2252 | HPV | 16 | 4 | 21 | B*5102 | FAFLQDTV | 2327 | 1210.00 | 8 |
| 2253 | HPV | 16 | 4 | 21 | A*0201 | MITAGFLYV | 2328 | 169.89 | 9 |
| 2254 | HPV | 16 | 4 | 21 | B*5801 | ITAGFLYVF | 2329 | 118.80 | 9 |
| 2255 | HPV | 16 | 4 | 21 | A*0201 | FLYVFLMIC | 2330 | 262.05 | 9 |
| 2256 | HPV | 16 | 4 | 21 | A68.1 | YVFLMICNK | 2331 | 240.00 | 9 |
| 2257 | HPV | 16 | 4 | 21 | B*2705 | DRSTDPLYY | 2332 | 100.00 | 9 |
| 2258 | HPV | 16 | 4 | 21 | A*0201 | GIFAFCPDV | 2333 | 134.46 | 9 |
| 2259 | HPV | 16 | 4 | 21 | Cw*0401 | IFAFCPDVF | 2334 | 100.00 | 9 |
| 2260 | HPV | 16 | 4 | 21 | Cw*0401 | AFCPDVFAF | 2335 | 240.00 | 9 |
| 2261 | HPV | 16 | 4 | 21 | Cw*0401 | AFLQDTVAF | 2336 | 100.00 | 9 |
| 2262 | HPV | 16 | 4 | 21 | B*5102 | AGFLYVFLMI | 2337 | 484.00 | 10 |
| 2263 | HPV | 16 | 4 | 21 | B*5201 | AGFLYVFLMI | 2337 | 180.00 | 10 |
| 2264 | HPV | 16 | 4 | 21 | A*0201 | FLMICNKTYI | 2338 | 976.61 | 10 |
| 2265 | HPV | 16 | 4 | 21 | Cw*0401 | TYIDRSTDPL | 2339 | 240.00 | 10 |
| 2266 | HPV | 16 | 4 | 21 | A24 | TYIDRSTDPL | 2339 | 360.00 | 10 |
| 2267 | HPV | 16 | 4 | 21 | A1 | STDPLYYGIF | 2340 | 125.00 | 10 |
| 2268 | HPV | 16 | 4 | 21 | B*5102 | YGIFAFCPDV | 2341 | 240.00 | 10 |
| 2269 | HPV | 16 | 4 | 21 | Cw*0401 | AFCPDVFAFL | 2342 | 288.00 | 10 |
| 2270 | HPV | 16 | 4 | 23 | B*5102 | NPEKQSHI | 2343 | 242.00 | 8 |

TABLE 7-continued

| No | Species | Strain type | Frame | ORF | HLA | Seq | Seq ID No. | Score | Length |
|---|---|---|---|---|---|---|---|---|---|
| 2271 | HPV | 16 | 4 | 23 | B*2705 | KQSHIPHV | 2344 | 180.00 | 8 |
| 2272 | HPV | 16 | 4 | 23 | B*5102 | IPHVAVTV | 2345 | 200.00 | 8 |
| 2273 | HPV | 16 | 4 | 23 | B*5103 | VACSTHILI | 2346 | 110.00 | 9 |
| 2274 | HPV | 16 | 4 | 23 | B*5102 | VACSTHILI | 2346 | 220.00 | 9 |
| 2275 | HPV | 16 | 4 | 23 | B*2705 | KQSHIPHVAV | 2347 | 180.00 | 10 |
| 2276 | HPV | 16 | 5 | 1 | B*2705 | LRVVSTTV | 2348 | 600.00 | 8 |
| 2277 | HPV | 16 | 5 | 1 | B*5102 | LPQQMPLL | 2349 | 110.00 | 8 |
| 2278 | HPV | 16 | 5 | 1 | B*2705 | LRVVSTTVT | 2350 | 200.00 | 9 |
| 2279 | HPV | 16 | 5 | 1 | B*5801 | VSTTVTNSW | 2351 | 132.00 | 9 |
| 2280 | HPV | 16 | 5 | 1 | Cw*0301 | SWLPQQMPL | 2352 | 120.00 | 9 |
| 2281 | HPV | 16 | 5 | 1 | A*0201 | WLPQQMPLL | 2353 | 226.01 | 9 |
| 2282 | HPV | 16 | 5 | 1 | B*2705 | LRVVSTTVTN | 2354 | 200.00 | 10 |
| 2283 | HPV | 16 | 5 | 1 | Cw*0301 | SWLPQQMPLL | 2355 | 200.00 | 10 |
| 2284 | HPV | 16 | 5 | 2 | B*5102 | FAVDPEPL | 2356 | 300.00 | 8 |
| 2285 | HPV | 16 | 5 | 2 | B*5102 | SPTVPALL | 2357 | 100.00 | 8 |
| 2286 | HPV | 16 | 5 | 2 | Cw*0401 | KFAVDPEPL | 2358 | 200.00 | 9 |
| 2287 | HPV | 16 | 5 | 2 | A1 | AVDPEPLMY | 2359 | 1250.00 | 9 |
| 2288 | HPV | 16 | 5 | 2 | B*2705 | LMYKSSGTF | 2360 | 125.00 | 9 |
| 2289 | HPV | 16 | 5 | 2 | Cw*0401 | TFSPTVPAL | 2361 | 576.00 | 9 |
| 2290 | HPV | 16 | 5 | 2 | B*5102 | VPALLNKCL | 2362 | 133.10 | 9 |
| 2291 | HPV | 16 | 5 | 2 | Cw*0401 | KFAVDPEPLM | 2363 | 100.00 | 10 |
| 2292 | HPV | 16 | 5 | 2 | A1 | AVDPEPLMYK | 2364 | 500.00 | 10 |
| 2293 | HPV | 16 | 5 | 2 | A68.1 | AVDPEPLMYK | 2364 | 180.00 | 10 |
| 2294 | HPV | 16 | 5 | 2 | Cw*0401 | TFSPTVPALL | 2365 | 288.00 | 10 |
| 2295 | HPV | 16 | 5 | 3 | B*5102 | SPYGSDTI | 2366 | 2200.00 | 8 |
| 2296 | HPV | 16 | 5 | 3 | B*5102 | YGSDTILI | 2367 | 193.60 | 8 |
| 2297 | HPV | 16 | 5 | 3 | B*5102 | SPYGSDTIL | 2368 | 550.00 | 9 |
| 2298 | HPV | 16 | 5 | 3 | B*5102 | SPYGSDTILI | 2369 | 2420.00 | 10 |
| 2299 | HPV | 16 | 5 | 3 | B*5103 | SPYGSDTILI | 2369 | 145.20 | 10 |
| 2300 | HPV | 16 | 5 | 4 | B*5102 | NPDTLGTNI | 2370 | 220.00 | 9 |
| 2301 | HPV | 16 | 5 | 4 | A*0201 | ILLLLGFLI | 2371 | 380.61 | 9 |
| 2302 | HPV | 16 | 5 | 4 | A3 | LLLGFLIGK | 2372 | 405.00 | 9 |
| 2303 | HPV | 16 | 5 | 4 | Cw*0401 | NPDTLGTNIL | 2373 | 120.00 | 10 |
| 2304 | HPV | 16 | 5 | 4 | A3 | LLLLGFLIGK | 2374 | 270.00 | 10 |
| 2305 | HPV | 16 | 5 | 5 | B*2705 | YRWVSESG | 2375 | 100.00 | 8 |
| 2306 | HPV | 16 | 5 | 5 | B*2705 | LQYRWVSES | 2376 | 100.00 | 9 |
| 2307 | HPV | 16 | 5 | 5 | B*2702 | YRWVSESGI | 2377 | 300.00 | 9 |
| 2308 | HPV | 16 | 5 | 5 | B*2705 | YRWVSESGI | 2377 | 3000.00 | 9 |
| 2309 | HPV | 16 | 5 | 5 | B*2702 | YRWVSESGII | 2378 | 300.00 | 10 |
| 2310 | HPV | 16 | 5 | 5 | B*2705 | YRWVSESGII | 2378 | 3000.00 | 10 |
| 2311 | HPV | 16 | 5 | 6 | B*2705 | SRCTFCAF | 2379 | 1000.00 | 8 |
| 2312 | HPV | 16 | 5 | 6 | B*5102 | CAFCRTFV | 2380 | 550.00 | 8 |
| 2313 | HPV | 16 | 5 | 6 | B*2705 | CRTFVSHC | 2381 | 200.00 | 8 |
| 2314 | HPV | 16 | 5 | 6 | B*2705 | SRCTFCAFC | 2382 | 200.00 | 9 |
| 2315 | HPV | 16 | 5 | 6 | Cw*0401 | TFCAFCRTF | 2383 | 100.00 | 9 |
| 2316 | HPV | 16 | 5 | 6 | A*0201 | KLGSRCTFCA | 2384 | 100.85 | 10 |
| 2317 | HPV | 16 | 5 | 6 | B*2705 | SRCTFCAFCR | 2385 | 1000.00 | 10 |
| 2318 | HPV | 16 | 5 | 7 | B*2705 | LQYTMYNA | 2386 | 100.00 | 8 |
| 2319 | HPV | 16 | 5 | 7 | B*2702 | LQYTMYNAF | 2387 | 100.00 | 9 |
| 2320 | HPV | 16 | 5 | 7 | B*2705 | LQYTMYNAF | 2387 | 500.00 | 9 |
| 2321 | HPV | 16 | 5 | 9 | B*5102 | NALYCICL | 2388 | 165.00 | 8 |
| 2322 | HPV | 16 | 5 | 9 | B*3901 | LHQTALPL | 2389 | 135.00 | 8 |
| 2323 | HPV | 16 | 5 | 9 | B*2705 | HQTALPLY | 2390 | 100.00 | 8 |
| 2324 | HPV | 16 | 5 | 9 | B*3901 | IHVFLYIL | 2391 | 180.00 | 8 |
| 2325 | HPV | 16 | 5 | 9 | A*0201 | MLLHKYIYV | 2396 | 3609.23 | 9 |
| 2326 | HPV | 16 | 5 | 9 | B*5103 | TALPLYIHV | 2397 | 132.00 | 9 |
| 2327 | HPV | 16 | 5 | 9 | B*5102 | TALPLYIHV | 2397 | 300.00 | 9 |
| 2328 | HPV | 16 | 5 | 9 | B*5102 | LPLYIHVFL | 2398 | 300.00 | 9 |
| 2329 | HPV | 16 | 5 | 9 | A24 | LYIHVFLYI | 2399 | 126.00 | 9 |
| 2330 | HPV | 16 | 5 | 9 | B*3901 | IHVFLYILL | 2400 | 180.00 | 9 |
| 2331 | HPV | 16 | 5 | 9 | Cw*0301 | IHVFLYILL | 2400 | 100.00 | 9 |
| 2332 | HPV | 16 | 5 | 9 | A*0201 | FLYILLVQL | 2401 | 723.25 | 9 |
| 2333 | HPV | 16 | 5 | 9 | A*0205 | FLYILLVQL | 2401 | 126.00 | 9 |
| 2334 | HPV | 16 | 5 | 9 | B*2705 | FLYILLVQL | 2401 | 150.00 | 9 |
| 2335 | HPV | 16 | 5 | 9 | A*0201 | ILLVQLNTL | 2402 | 309.05 | 9 |
| 2336 | HPV | 16 | 5 | 9 | A*0201 | LMLLHKYIYV | 2403 | 2606.66 | 10 |
| 2337 | HPV | 16 | 5 | 9 | Cw*0301 | IYVSSLYNAL | 2404 | 100.00 | 10 |
| 2338 | HPV | 16 | 5 | 9 | Cw*0401 | IYVSSLYNAL | 2404 | 200.00 | 10 |
| 2339 | HPV | 16 | 5 | 9 | A24 | IYVSSLYNAL | 2404 | 432.00 | 10 |
| 2340 | HPV | 16 | 5 | 9 | Cw*0401 | LYNALYCICL | 2405 | 200.00 | 10 |
| 2341 | HPV | 16 | 5 | 9 | A24 | LYNALYCICL | 2405 | 300.00 | 10 |
| 2342 | HPV | 16 | 5 | 9 | A*0201 | ALPLYIHVFL | 2406 | 117.49 | 10 |
| 2343 | HPV | 16 | 5 | 9 | Cw*0401 | LYIHVFLYIL | 2407 | 400.00 | 10 |
| 2344 | HPV | 16 | 5 | 9 | A24 | LYIHVFLYIL | 2407 | 300.00 | 10 |
| 2345 | HPV | 16 | 5 | 9 | Cw*0401 | VFLYILLVQL | 2408 | 400.00 | 10 |
| 2346 | HPV | 16 | 5 | 9 | A*0201 | YILLVQLNTL | 2409 | 114.98 | 10 |

TABLE 7-continued

| No | Species | Strain type | Frame | ORF | HLA | Seq | Seq ID No. | Score | Length |
|---|---|---|---|---|---|---|---|---|---|
| 2347 | HPV | 16 | 5 | 9 | A*0205 | YILLVQLNTL | 2409 | 126.00 | 10 |
| 2348 | HPV | 16 | 5 | 10 | B*5102 | CPDTHLNV | 2410 | 110.00 | 8 |
| 2349 | HPV | 16 | 5 | 10 | B*2705 | FQFLSLSS | 2411 | 100.00 | 8 |
| 2350 | HPV | 16 | 5 | 10 | A24 | LYYHFHNVL | 2412 | 240.00 | 9 |
| 2351 | HPV | 16 | 5 | 10 | Cw*0401 | LYYHFHNVL | 2412 | 200.00 | 9 |
| 2352 | HPV | 16 | 5 | 10 | B60 | LEKKDFQFL | 2413 | 160.00 | 9 |
| 2353 | HPV | 16 | 5 | 10 | B*2702 | FQFLSLSSY | 2414 | 100.00 | 9 |
| 2354 | HPV | 16 | 5 | 10 | B*2705 | FQFLSLSSY | 2414 | 500.00 | 9 |
| 2355 | HPV | 16 | 5 | 10 | Cw*0401 | YYHFHNVLVF | 2415 | 300.00 | 10 |
| 2356 | HPV | 16 | 5 | 10 | A24 | YYHFHNVLVF | 2415 | 100.00 | 10 |
| 2357 | HPV | 16 | 5 | 10 | A3 | KLNLDHVLEK | 2416 | 360.00 | 10 |
| 2358 | HPV | 16 | 5 | 10 | B*2705 | FQFLSLSSYT | 2417 | 100.00 | 10 |
| 2359 | HPV | 16 | 5 | 10 | B*5102 | FPFSSNGNSL | 2418 | 1100.00 | 10 |
| 2360 | HPV | 16 | 5 | 10 | A68.1 | NVNTTNLLCK | 2419 | 120.00 | 10 |
| 2361 | HPV | 16 | 5 | 11 | B*2705 | HQSQHVDL | 2420 | 200.00 | 8 |
| 2362 | HPV | 16 | 5 | 11 | B*2705 | SQHVDLLL | 2421 | 200.00 | 8 |
| 2363 | HPV | 16 | 5 | 11 | B*3901 | QHVDLLLL | 2422 | 540.00 | 8 |
| 2364 | HPV | 16 | 5 | 11 | B*5102 | IAAFALLV | 2423 | 100.00 | 8 |
| 2365 | HPV | 16 | 5 | 11 | B*3901 | WHIVCLSL | 2424 | 270.00 | 8 |
| 2366 | HPV | 16 | 5 | 11 | B*5102 | TPSPPLPL | 2425 | 100.00 | 8 |
| 2367 | HPV | 16 | 5 | 11 | B*5102 | LGVSPNAAI | 2426 | 264.00 | 9 |
| 2368 | HPV | 16 | 5 | 11 | B*5102 | AAIHQSQHV | 2427 | 110.00 | 9 |
| 2369 | HPV | 16 | 5 | 11 | B*5103 | AAIHQSQHV | 2427 | 399.30 | 9 |
| 2370 | HPV | 16 | 5 | 11 | B*2705 | HQSQHVDLL | 2428 | 200.00 | 9 |
| 2371 | HPV | 16 | 5 | 11 | B*2705 | SQHVDLLLL | 2429 | 200.00 | 9 |
| 2372 | HPV | 16 | 5 | 11 | B*5102 | NGLTNSEKL | 2430 | 159.72 | 9 |
| 2373 | HPV | 16 | 5 | 11 | Cw*0301 | EKLTPYNSL | 2431 | 100.00 | 9 |
| 2374 | HPV | 16 | 5 | 11 | B*5102 | FANIAAFAL | 2432 | 100.00 | 9 |
| 2375 | HPV | 16 | 5 | 11 | Cw*0301 | ANIAAFALL | 2433 | 100.00 | 9 |
| 2376 | HPV | 16 | 5 | 11 | A*0201 | LLVFSTFKI | 2434 | 102.87 | 9 |
| 2377 | HPV | 16 | 5 | 11 | B7 | TPSPPLPLL | 2435 | 120.00 | 9 |
| 2378 | HPV | 16 | 5 | 11 | Cw*0401 | TPSPPLPLL | 2435 | 192.00 | 9 |
| 2379 | HPV | 16 | 5 | 11 | B*5102 | TPSPPLPLL | 2435 | 100.00 | 9 |
| 2380 | HPV | 16 | 5 | 11 | B*5102 | NAAIHQSQHV | 2436 | 121.00 | 10 |
| 2381 | HPV | 16 | 5 | 11 | B*5103 | NAAIHQSQHV | 2436 | 110.00 | 10 |
| 2382 | HPV | 16 | 5 | 11 | B*3901 | IHQSQHVDLL | 2437 | 135.00 | 10 |
| 2383 | HPV | 16 | 5 | 11 | B*2705 | HQSQHVDLLL | 2438 | 200.00 | 10 |
| 2384 | HPV | 16 | 5 | 11 | B60 | SEKLTPYNSL | 2439 | 160.00 | 10 |
| 2385 | HPV | 16 | 5 | 11 | Cw*0401 | NFANIAAFAL | 2440 | 220.00 | 10 |
| 2386 | HPV | 16 | 5 | 11 | B*5102 | FANIAAFALL | 2441 | 100.00 | 10 |
| 2387 | HPV | 16 | 5 | 11 | Cw*0401 | AFALLVFSTF | 2442 | 100.00 | 10 |
| 2388 | HPV | 16 | 5 | 11 | A*0201 | ALLVFSTFKI | 2443 | 223.89 | 10 |
| 2389 | HPV | 16 | 5 | 11 | A*0201 | LVFSTFKIFV | 2444 | 800.05 | 10 |
| 2390 | HPV | 16 | 5 | 11 | A*0201 | KIFVSGVWHI | 2445 | 320.45 | 10 |
| 2391 | HPV | 16 | 5 | 12 | B*5102 | QPPPLPPL | 2446 | 100.00 | 8 |
| 2392 | HPV | 16 | 5 | 12 | B*2705 | LQPPPLPPL | 2447 | 200.00 | 9 |
| 2393 | HPV | 16 | 5 | 12 | B*2705 | LQPPPLPPLY | 2448 | 100.00 | 10 |
| 2394 | HPV | 16 | 5 | 12 | B62 | LQPPPLPPLY | 2448 | 192.00 | 10 |
| 2395 | HPV | 16 | 5 | 13 | B*5102 | AALLCFSI | 2449 | 660.00 | 8 |
| 2396 | HPV | 16 | 5 | 13 | B*5102 | IAFNLGLI | 2450 | 1100.00 | 8 |
| 2397 | HPV | 16 | 5 | 13 | B*5102 | SGLPNTFV | 2451 | 145.20 | 8 |
| 2398 | HPV | 16 | 5 | 13 | B*5102 | EPVLHLYV | 2452 | 660.00 | 8 |
| 2399 | HPV | 16 | 5 | 13 | B*3901 | LHLYVVLL | 2453 | 270.00 | 8 |
| 2400 | HPV | 16 | 5 | 13 | B*5103 | FAALLCFSI | 2454 | 110.00 | 9 |
| 2401 | HPV | 16 | 5 | 13 | B*5102 | FAALLCFSI | 2454 | 440.00 | 9 |
| 2402 | HPV | 16 | 5 | 13 | A*0201 | ALLCFSIHI | 2455 | 146.69 | 9 |
| 2403 | HPV | 16 | 5 | 13 | B*3901 | IHIAFNLGL | 2456 | 180.00 | 9 |
| 2404 | HPV | 16 | 5 | 13 | B*5102 | IAFNLGLIL | 2457 | 275.00 | 9 |
| 2405 | HPV | 16 | 5 | 13 | Cw*0401 | AFNLGLILL | 2458 | 400.00 | 9 |
| 2406 | HPV | 16 | 5 | 13 | Cw*0401 | HPLISLSGL | 2459 | 160.00 | 9 |
| 2407 | HPV | 16 | 5 | 13 | B*5102 | HPLISLSGL | 2459 | 300.00 | 9 |
| 2408 | HPV | 16 | 5 | 13 | B62 | SLSGLPNTF | 2460 | 105.60 | 9 |
| 2409 | HPV | 16 | 5 | 13 | Cw*0301 | SGLPNTFVL | 2461 | 120.00 | 9 |
| 2410 | HPV | 16 | 5 | 13 | A*0201 | FVLEPVLHL | 2462 | 300.01 | 9 |
| 2411 | HPV | 16 | 5 | 13 | A*0205 | FVLEPVLHL | 2462 | 756.00 | 9 |
| 2412 | HPV | 16 | 5 | 13 | A1 | VLEPVLHLY | 2463 | 450.00 | 9 |
| 2413 | HPV | 16 | 5 | 13 | B*5102 | EPVLHLYVV | 2464 | 660.00 | 9 |
| 2414 | HPV | 16 | 5 | 13 | B*5102 | AALLCFSIHI | 2465 | 660.00 | 10 |
| 2415 | HPV | 16 | 5 | 13 | B*5103 | AALLCFSIHI | 2465 | 132.00 | 10 |
| 2416 | HPV | 16 | 5 | 13 | Cw*0401 | CFSIHIAFNL | 2466 | 200.00 | 10 |
| 2417 | HPV | 16 | 5 | 13 | B*5102 | IAFNLGLILL | 2467 | 302.50 | 10 |
| 2418 | HPV | 16 | 5 | 13 | B*3901 | THPLISLSGL | 2468 | 135.00 | 10 |
| 2419 | HPV | 16 | 5 | 13 | B*5801 | ISLSGLPNTF | 2469 | 108.90 | 10 |
| 2420 | HPV | 16 | 5 | 13 | A*0201 | SLSGLPNTFV | 2470 | 382.54 | 10 |
| 2421 | HPV | 16 | 5 | 13 | B*5102 | LPNTFVLEPV | 2471 | 266.20 | 10 |
| 2422 | HPV | 16 | 5 | 13 | Cw*0401 | TFVLEPVLHL | 2472 | 440.00 | 10 |

TABLE 7-continued

| No | Species | Strain type | Frame | ORF | HLA | Seq | Seq ID No. | Score | Length |
|---|---|---|---|---|---|---|---|---|---|
| 2423 | HPV | 16 | 5 | 13 | B*5102 | EPVLHLYVVL | 2473 | 330.00 | 10 |
| 2424 | HPV | 16 | 5 | 13 | Cw*0301 | EPVLHLYVVL | 2473 | 100.00 | 10 |
| 2425 | HPV | 16 | 5 | 14 | B*5102 | LPVLNNHYHL | 2474 | 363.00 | 10 |
| 2426 | HPV | 16 | 5 | 16 | B*3901 | IHYIPYPL | 2475 | 180.00 | 8 |
| 2427 | HPV | 16 | 5 | 16 | B*5102 | YPLPHWYL | 2476 | 600.00 | 8 |
| 2428 | HPV | 16 | 5 | 16 | Cw*0401 | LFFFPLQPL | 2477 | 400.00 | 9 |
| 2429 | HPV | 16 | 5 | 16 | B*5102 | FPLQPLHKT | 2478 | 132.00 | 9 |
| 2430 | HPV | 16 | 5 | 16 | B*5102 | FPLQPLHKTI | 2479 | 3194.40 | 10 |
| 2431 | HPV | 16 | 5 | 16 | B*2705 | LQPLHKTIHY | 2480 | 100.00 | 10 |
| 2432 | HPV | 16 | 5 | 16 | B*5102 | QPLHKTIHYI | 2481 | 1756.92 | 10 |
| 2433 | HPV | 16 | 5 | 16 | B7 | IPYPLPHWYL | 2482 | 120.00 | 10 |
| 2434 | HPV | 16 | 5 | 16 | B*5102 | IPYPLPHWYL | 2482 | 550.00 | 10 |
| 2435 | HPV | 16 | 5 | 16 | Cw*0301 | IPYPLPHWYL | 2482 | 100.00 | 10 |
| 2436 | HPV | 16 | 5 | 17 | B*2705 | HLFHPPPL | 2483 | 150.00 | 8 |
| 2437 | HPV | 16 | 5 | 17 | B*5102 | PPLSCHLI | 2484 | 120.00 | 8 |
| 2438 | HPV | 16 | 5 | 17 | B*2705 | SRDQLSLV | 2485 | 600.00 | 8 |
| 2439 | HPV | 16 | 5 | 17 | B*3901 | DHLFHPPPL | 2486 | 180.00 | 9 |
| 2440 | HPV | 16 | 5 | 17 | Cw*0401 | HPPPLSCHL | 2487 | 105.60 | 9 |
| 2441 | HPV | 16 | 5 | 17 | B*5102 | HPPPLSCHL | 2487 | 100.00 | 9 |
| 2442 | HPV | 16 | 5 | 17 | B*2705 | SRDQLSLVA | 2488 | 200.00 | 9 |
| 2443 | HPV | 16 | 5 | 17 | A*0201 | SLVANLTYI | 2489 | 131.97 | 9 |
| 2444 | HPV | 16 | 5 | 17 | B*5102 | HPPPLSCHLI | 2490 | 400.00 | 10 |
| 2445 | HPV | 16 | 5 | 17 | B*2705 | SRDQLSLVAN | 2491 | 200.00 | 10 |
| 2446 | HPV | 16 | 5 | 19 | B*5102 | FGYALSFI | 2492 | 800.00 | 8 |
| 2447 | HPV | 16 | 5 | 19 | A*0205 | WVLKHCSSL | 2493 | 126.00 | 9 |
| 2448 | HPV | 16 | 5 | 19 | B*5102 | YALSFIHEL | 2494 | 330.00 | 9 |
| 2449 | HPV | 16 | 5 | 19 | A*0205 | WVLKHCSSLL | 2495 | 126.00 | 10 |
| 2450 | HPV | 16 | 5 | 19 | B62 | ILTGFGSTDF | 2496 | 149.76 | 10 |
| 2451 | HPV | 16 | 5 | 19 | B*3701 | TDFGYALSFI | 2497 | 200.00 | 10 |
| 2452 | HPV | 16 | 5 | 19 | Cw*0401 | GYALSFIHEL | 2498 | 400.00 | 10 |
| 2453 | HPV | 16 | 5 | 19 | A24 | GYALSFIHEL | 2498 | 220.00 | 10 |
| 2454 | HPV | 16 | 5 | 19 | B*5102 | YALSFIHELL | 2499 | 330.00 | 10 |
| 2455 | HPV | 16 | 5 | 1 | B*5103 | CAVLQMNNV | 2500 | 121.00 | 9 |
| 2456 | HPV | 16 | 5 | 1 | B*5102 | CAVLQMNNV | 2500 | 363.00 | 9 |
| 2457 | HPV | 16 | 5 | 2 | B*5102 | KALAHSDL | 2501 | 150.00 | 8 |
| 2458 | HPV | 16 | 5 | 2 | A*0201 | ALAHSDLFYM | 2502 | 364.50 | 10 |
| 2459 | HPV | 16 | 5 | 3 | B*2705 | CRSGKQGF | 2503 | 1000.00 | 8 |
| 2460 | HPV | 16 | 5 | 3 | B*2705 | KQETYKFK | 2504 | 600.00 | 8 |
| 2461 | HPV | 16 | 5 | 3 | B*2705 | KQGFGTHGK | 2505 | 600.00 | 9 |
| 2462 | HPV | 16 | 5 | 3 | A68.1 | MVGKQCRSGK | 2506 | 240.00 | 10 |
| 2463 | HPV | 16 | 5 | 3 | B*2705 | KQCRSGKQGF | 2507 | 300.00 | 10 |
| 2464 | HPV | 16 | 5 | 3 | B*2705 | CRSGKQGFGT | 2508 | 200.00 | 10 |
| 2465 | HPV | 16 | 5 | 6 | B*5102 | AAHNDIFV | 2509 | 121.00 | 8 |
| 2466 | HPV | 16 | 5 | 6 | B*3901 | AHNDIFVL | 2510 | 180.00 | 8 |
| 2467 | HPV | 16 | 5 | 6 | B*2705 | LRVVSTTV | 2348 | 600.00 | 8 |
| 2468 | HPV | 16 | 5 | 6 | B*5102 | LPQQMPLL | 2349 | 110.00 | 8 |
| 2469 | HPV | 16 | 5 | 6 | B*5103 | MAAHNDIFV | 2511 | 110.00 | 9 |
| 2470 | HPV | 16 | 5 | 6 | B*5102 | MAAHNDIFV | 2511 | 121.00 | 9 |
| 2471 | HPV | 16 | 5 | 6 | B*2705 | LRVVSTTVT | 2350 | 200.00 | 9 |
| 2472 | HPV | 16 | 5 | 6 | B*5801 | VSTTVTNSW | 2351 | 132.00 | 9 |
| 2473 | HPV | 16 | 5 | 6 | Cw*0301 | SWLPQQMPL | 2352 | 120.00 | 9 |
| 2474 | HPV | 16 | 5 | 6 | A*0201 | WLPQQMPLL | 2353 | 226.01 | 9 |
| 2475 | HPV | 16 | 5 | 6 | A*0201 | FVLRVVSTTV | 2512 | 103.58 | 10 |
| 2476 | HPV | 16 | 5 | 6 | B*2705 | LRVVSTTVTN | 2354 | 200.00 | 10 |
| 2477 | HPV | 16 | 5 | 6 | Cw*0301 | SWLPQQMPLL | 2355 | 200.00 | 10 |
| 2478 | HPV | 16 | 5 | 7 | B*5102 | SPTVPALL | 2357 | 100.00 | 8 |
| 2479 | HPV | 16 | 5 | 7 | Cw*0401 | TFSPTVPAL | 2361 | 576.00 | 9 |
| 2480 | HPV | 16 | 5 | 7 | B*5102 | VPALLNKCL | 2362 | 133.10 | 9 |
| 2481 | HPV | 16 | 5 | 7 | Cw*0401 | TFSPTVPALL | 2365 | 288.00 | 10 |
| 2482 | HPV | 16 | 5 | 8 | B*2705 | VRATYSSV | 2513 | 600.00 | 8 |
| 2483 | HPV | 16 | 5 | 8 | B*2705 | VRATYSSVL | 2514 | 2000.00 | 9 |
| 2484 | HPV | 16 | 5 | 8 | A24 | TYSSVLTTL | 2515 | 280.00 | 9 |
| 2485 | HPV | 16 | 5 | 8 | Cw*0401 | TYSSVLTTL | 2515 | 400.00 | 9 |
| 2486 | HPV | 16 | 5 | 8 | B7 | FVRATYSSVL | 2516 | 200.00 | 10 |
| 2487 | HPV | 16 | 5 | 8 | B*2705 | VRATYSSVLT | 2517 | 200.00 | 10 |
| 2488 | HPV | 16 | 5 | 9 | B*2705 | YRFSTTST | 2518 | 1000.00 | 8 |
| 2489 | HPV | 16 | 5 | 9 | A*0201 | YLSTYRFST | 2519 | 198.82 | 9 |
| 2490 | HPV | 16 | 5 | 10 | B*2705 | CRCWRLQY | 2520 | 1000.00 | 8 |
| 2491 | HPV | 16 | 5 | 10 | B*2705 | WRLQYRWV | 2521 | 600.00 | 8 |
| 2492 | HPV | 16 | 5 | 10 | B*2705 | YRWVSESG | 2375 | 100.00 | 8 |
| 2493 | HPV | 16 | 5 | 10 | B*2705 | CRCWRLQYR | 2522 | 1000.00 | 9 |
| 2494 | HPV | 16 | 5 | 10 | B*2705 | WRLQYRWVS | 2523 | 200.00 | 9 |
| 2495 | HPV | 16 | 5 | 10 | B*2705 | LQYRWVSES | 2376 | 100.00 | 9 |
| 2496 | HPV | 16 | 5 | 10 | B*2702 | YRWVSESGI | 2377 | 300.00 | 9 |
| 2497 | HPV | 16 | 5 | 10 | B*2705 | YRWVSESGI | 2377 | 3000.00 | 9 |
| 2498 | HPV | 16 | 5 | 10 | B*2702 | CRCWRLQYRW | 2524 | 100.00 | 10 |

TABLE 7-continued

| No | Species | Strain type | Frame | ORF | HLA | Seq | Seq ID No. | Score | Length |
|---|---|---|---|---|---|---|---|---|---|
| 2499 | HPV | 16 | 5 | 10 | B*2705 | CRCWRLQYRW | 2524 | 200.00 | 10 |
| 2500 | HPV | 16 | 5 | 10 | B*2702 | YRWVSESGII | 2378 | 300.00 | 10 |
| 2501 | HPV | 16 | 5 | 10 | B*2705 | YRWVSESGII | 2378 | 3000.00 | 10 |
| 2502 | HPV | 16 | 5 | 11 | B*5102 | LPQLLMLL | 2525 | 110.00 | 8 |
| 2503 | HPV | 16 | 5 | 11 | B*5102 | NALYCICL | 2388 | 165.00 | 8 |
| 2504 | HPV | 16 | 5 | 11 | B*3901 | LHQTALPL | 2389 | 135.00 | 8 |
| 2505 | HPV | 16 | 5 | 11 | B*2705 | HQTALPLY | 2390 | 100.00 | 8 |
| 2506 | HPV | 16 | 5 | 11 | B*3901 | IHVFLYIL | 2391 | 180.00 | 8 |
| 2507 | HPV | 16 | 5 | 11 | B*3901 | NHNSQLDPL | 2392 | 135.00 | 9 |
| 2508 | HPV | 16 | 5 | 11 | A*0205 | SQLDPLPQL | 2393 | 100.80 | 9 |
| 2509 | HPV | 16 | 5 | 11 | B*2705 | SQLDPLPQL | 2393 | 200.00 | 9 |
| 2510 | HPV | 16 | 5 | 11 | Cw*0301 | DPLPQLLML | 2394 | 100.00 | 9 |
| 2511 | HPV | 16 | 5 | 11 | Cw*0401 | DPLPQLLML | 2394 | 192.00 | 9 |
| 2512 | HPV | 16 | 5 | 11 | B*5102 | DPLPQLLML | 2394 | 330.00 | 9 |
| 2513 | HPV | 16 | 5 | 11 | A*0201 | LLMLLHKYI | 2395 | 360.92 | 9 |
| 2514 | HPV | 16 | 5 | 11 | A*0201 | MLLHKYIYV | 2396 | 3609.23 | 9 |
| 2515 | HPV | 16 | 5 | 11 | B*5103 | TALPLYTHV | 2397 | 132.00 | 9 |
| 2516 | HPV | 16 | 5 | 11 | B*5102 | TALPLYIHV | 2397 | 300.00 | 9 |
| 2517 | HPV | 16 | 5 | 11 | B*5102 | LPLYIHVFL | 2398 | 300.00 | 9 |
| 2518 | HPV | 16 | 5 | 11 | A24 | LYIHVFLYI | 2399 | 126.00 | 9 |
| 2519 | HPV | 16 | 5 | 11 | B*3901 | IHVFLYILL | 2400 | 180.00 | 9 |
| 2520 | HPV | 16 | 5 | 11 | Cw*0301 | IHVFLYILL | 2400 | 100.00 | 9 |
| 2521 | HPV | 16 | 5 | 11 | A*0201 | FLYILLVQL | 2401 | 723.25 | 9 |
| 2522 | HPV | 16 | 5 | 11 | A*0205 | FLYILLVQL | 2401 | 126.00 | 9 |
| 2523 | HPV | 16 | 5 | 11 | B*2705 | FLYILLVQL | 2401 | 150.00 | 9 |
| 2524 | HPV | 16 | 5 | 11 | A*0201 | ILLVQLNTL | 2402 | 309.05 | 9 |
| 2525 | HPV | 16 | 5 | 11 | B*2705 | SQLDPLPQLL | 2526 | 200.00 | 10 |
| 2526 | HPV | 16 | 5 | 11 | B*3701 | LDPLPQLLML | 2527 | 200.00 | 10 |
| 2527 | HPV | 16 | 5 | 11 | B*5102 | DPLPQLLMLL | 2528 | 300.00 | 10 |
| 2528 | HPV | 16 | 5 | 11 | Cw*0301 | DPLPQLLMLL | 2528 | 120.00 | 10 |
| 2529 | HPV | 16 | 5 | 11 | Cw*0401 | DPLPQLLMLL | 2528 | 192.00 | 10 |
| 2530 | HPV | 16 | 5 | 11 | A*0201 | QLLMLLHKYI | 2529 | 212.31 | 10 |
| 2531 | HPV | 16 | 5 | 11 | A*0201 | LMLLHKYIYV | 2403 | 2606.66 | 10 |
| 2532 | HPV | 16 | 5 | 11 | Cw*0301 | IYVSSLYNAL | 2404 | 100.00 | 10 |
| 2533 | HPV | 16 | 5 | 11 | Cw*0401 | IYVSSLYNAL | 2404 | 200.00 | 10 |
| 2534 | HPV | 16 | 5 | 11 | A24 | IYVSSLYNAL | 2404 | 432.00 | 10 |
| 2535 | HPV | 16 | 5 | 11 | Cw*0401 | LYNALYCICL | 2405 | 200.00 | 10 |
| 2536 | HPV | 16 | 5 | 11 | A24 | LYNALYCICL | 2405 | 300.00 | 10 |
| 2537 | HPV | 16 | 5 | 11 | A*0201 | ALPLYIHVFL | 2406 | 117.49 | 10 |
| 2538 | HPV | 16 | 5 | 11 | Cw*0401 | LYIHVFLYIL | 2407 | 400.00 | 10 |
| 2539 | HPV | 16 | 5 | 11 | A24 | LYIHVFLYIL | 2407 | 300.00 | 10 |
| 2540 | HPV | 16 | 5 | 11 | Cw*0401 | VFLYILLVQL | 2408 | 400.00 | 10 |
| 2541 | HPV | 16 | 5 | 11 | A*0201 | YILLVQLNTL | 2409 | 114.98 | 10 |
| 2542 | HPV | 16 | 5 | 11 | A*0205 | YILLVQLNTL | 2409 | 126.00 | 10 |
| 2543 | HPV | 16 | 5 | 12 | B*2705 | VQLLVMLY | 2530 | 100.00 | 8 |
| 2544 | HPV | 16 | 5 | 12 | B*2705 | IQPVLAPL | 2531 | 200.00 | 8 |
| 2545 | HPV | 16 | 5 | 12 | A24 | HYYIVSYIL | 2532 | 280.00 | 9 |
| 2546 | HPV | 16 | 5 | 12 | Cw*0401 | HYYIVSYIL | 2532 | 200.00 | 9 |
| 2547 | HPV | 16 | 5 | 12 | A24 | YYIVSYILF | 2533 | 150.00 | 9 |
| 2548 | HPV | 16 | 5 | 12 | Cw*0401 | YYIVSYILF | 2533 | 100.00 | 9 |
| 2549 | HPV | 16 | 5 | 12 | A*0201 | YIVSYILFL | 2534 | 170.92 | 9 |
| 2550 | HPV | 16 | 5 | 12 | Cw*0301 | VSYILFLTL | 2535 | 120.00 | 9 |
| 2551 | HPV | 16 | 5 | 12 | A*0201 | ILFLTLVAV | 2536 | 1006.21 | 9 |
| 2552 | HPV | 16 | 5 | 12 | B*5102 | VAVQLLVML | 2537 | 165.00 | 9 |
| 2553 | HPV | 16 | 5 | 12 | A*0201 | QLLVMLYSL | 2538 | 181.79 | 9 |
| 2554 | HPV | 16 | 5 | 12 | A*0201 | MLYSLIQPV | 2539 | 870.23 | 9 |
| 2555 | HPV | 16 | 5 | 12 | A24 | LYSLIQPVL | 2540 | 280.00 | 9 |
| 2556 | HPV | 16 | 5 | 12 | Cw*0401 | LYSLIQPVL | 2540 | 200.00 | 9 |
| 2557 | HPV | 16 | 5 | 12 | B*3901 | FHYYIVSYIL | 2541 | 180.00 | 10 |
| 2558 | HPV | 16 | 5 | 12 | Cw*0401 | HYYIVSYILF | 2542 | 100.00 | 10 |
| 2559 | HPV | 16 | 5 | 12 | A24 | HYYIVSYILF | 2542 | 100.00 | 10 |
| 2560 | HPV | 16 | 5 | 12 | Cw*0401 | YYIVSYILFL | 2543 | 400.00 | 10 |
| 2561 | HPV | 16 | 5 | 12 | A24 | YYIVSYILFL | 2543 | 300.00 | 10 |
| 2562 | HPV | 16 | 5 | 12 | A*0201 | YILFLTLVAV | 2544 | 374.37 | 10 |
| 2563 | HPV | 16 | 5 | 12 | Cw*0401 | LFLTLVAVQL | 2545 | 200.00 | 10 |
| 2564 | HPV | 16 | 5 | 12 | A*0201 | FLTLVAVQLL | 2546 | 226.01 | 10 |
| 2565 | HPV | 16 | 5 | 12 | B*2705 | VQLLVMLYSL | 2547 | 200.00 | 10 |
| 2566 | HPV | 16 | 5 | 12 | A*0201 | VMLYSLIQPV | 2548 | 726.71 | 10 |
| 2567 | HPV | 16 | 5 | 12 | B*2705 | MLYSLIQPVL | 2549 | 150.00 | 10 |
| 2568 | HPV | 16 | 5 | 13 | B*5102 | NGLCFTSI | 2550 | 264.00 | 8 |
| 2569 | HPV | 16 | 5 | 13 | B*3901 | GHFSCTNGL | 2551 | 180.00 | 9 |
| 2570 | HPV | 16 | 5 | 13 | Cw*0401 | CFTSIETKF | 2552 | 110.00 | 9 |
| 2571 | HPV | 16 | 5 | 13 | B*5102 | FPSNAFLKL | 2553 | 440.00 | 9 |
| 2572 | HPV | 16 | 5 | 13 | Cw*0401 | HFSCTNGLCF | 2554 | 100.00 | 10 |
| 2573 | HPV | 16 | 5 | 13 | Cw*0401 | KFPSNAFLKL | 2555 | 242.00 | 10 |
| 2574 | HPV | 16 | 5 | 14 | B*2705 | MQFFLGMPC | 2556 | 100.00 | 9 |

TABLE 7-continued

| No | Species | Strain type | Frame | ORF | HLA | Seq | Seq ID No. | Score | Length |
|---|---|---|---|---|---|---|---|---|---|
| 2575 | HPV | 16 | 5 | 14 | B*2705 | MQFFLGMPCK | 2557 | 1000.00 | 10 |
| 2576 | HPV | 16 | 5 | 14 | Cw*0401 | FFLGMPCKNL | 2558 | 200.00 | 10 |
| 2577 | HPV | 16 | 5 | 14 | B*5102 | MPCKNLFNAV | 2559 | 220.00 | 10 |
| 2578 | HPV | 16 | 5 | 15 | B*2705 | KQYCCNSV | 2560 | 900.00 | 8 |
| 2579 | HPV | 16 | 5 | 15 | B*2705 | HQSQHVDL | 2420 | 200.00 | 8 |
| 2580 | HPV | 16 | 5 | 15 | B*2705 | SQHVDLLL | 2421 | 200.00 | 8 |
| 2581 | HPV | 16 | 5 | 15 | B*3901 | QHVDLLLL | 2422 | 540.00 | 8 |
| 2582 | HPV | 16 | 5 | 15 | B*5102 | IAAFALLV | 2423 | 100.00 | 8 |
| 2583 | HPV | 16 | 5 | 15 | B*3901 | WHIVCLSL | 2424 | 270.00 | 8 |
| 2584 | HPV | 16 | 5 | 15 | B*5102 | TPSPPLPL | 2425 | 100.00 | 8 |
| 2585 | HPV | 16 | 5 | 15 | B*2702 | KQYCCNSVF | 2561 | 300.00 | 9 |
| 2586 | HPV | 16 | 5 | 15 | B*2705 | KQYCCNSVF | 2561 | 1500.00 | 9 |
| 2587 | HPV | 16 | 5 | 15 | B*5201 | KQYCCNSVF | 2561 | 275.00 | 9 |
| 2588 | HPV | 16 | 5 | 15 | A*0201 | FILSAILGV | 2562 | 374.37 | 9 |
| 2589 | HPV | 16 | 5 | 15 | B*5102 | LGVSPNAAI | 2426 | 264.00 | 9 |
| 2590 | HPV | 16 | 5 | 15 | B*5103 | AAIHQSQHV | 2427 | 110.00 | 9 |
| 2591 | HPV | 16 | 5 | 15 | B*5102 | AAIHQSQHV | 2427 | 399.30 | 9 |
| 2592 | HPV | 16 | 5 | 15 | B*2705 | HQSQHVDLL | 2428 | 200.00 | 9 |
| 2593 | HPV | 16 | 5 | 15 | B*2705 | SQHVDLLLL | 2429 | 200.00 | 9 |
| 2594 | HPV | 16 | 5 | 15 | B*5102 | NGLTNSEKL | 2430 | 159.72 | 9 |
| 2595 | HPV | 16 | 5 | 15 | Cw*0301 | EKLTPYNSL | 2431 | 100.00 | 9 |
| 2596 | HPV | 16 | 5 | 15 | B*5102 | FANIAAFAL | 2432 | 100.00 | 9 |
| 2597 | HPV | 16 | 5 | 15 | Cw*0301 | ANIAAFALL | 2563 | 100.00 | 9 |
| 2598 | HPV | 16 | 5 | 15 | A*0201 | LLVFSTFKI | 2434 | 102.87 | 9 |
| 2599 | HPV | 16 | 5 | 15 | B7 | TPSPPLPLL | 2435 | 120.00 | 9 |
| 2600 | HPV | 16 | 5 | 15 | Cw*0401 | TPSPPLPLL | 2435 | 192.00 | 9 |
| 2601 | HPV | 16 | 5 | 15 | B*5102 | TPSPPLPLL | 2435 | 100.00 | 9 |
| 2602 | HPV | 16 | 5 | 15 | B*2705 | KQYCCNSVFI | 2564 | 900.00 | 10 |
| 2603 | HPV | 16 | 5 | 15 | B*5201 | KQYCCNSVFI | 2564 | 165.00 | 10 |
| 2604 | HPV | 16 | 5 | 15 | Cw*0401 | QYCCNSVFIL | 2565 | 400.00 | 10 |
| 2605 | HPV | 16 | 5 | 15 | A24 | QYCCNSVFIL | 2565 | 200.00 | 10 |
| 2606 | HPV | 16 | 5 | 15 | B*5102 | NAAIHQSQHV | 2436 | 121.00 | 10 |
| 2607 | HPV | 16 | 5 | 15 | B*5103 | NAAIHQSQHV | 2436 | 110.00 | 10 |
| 2608 | HPV | 16 | 5 | 15 | B*3901 | IHQSQHVDLL | 2437 | 135.00 | 10 |
| 2609 | HPV | 16 | 5 | 15 | B*2705 | HQSQHVDLLL | 2438 | 200.00 | 10 |
| 2610 | HPV | 16 | 5 | 15 | B60 | SEKLTPYNSL | 2439 | 160.00 | 10 |
| 2611 | HPV | 16 | 5 | 15 | Cw*0401 | NFANIAAFAL | 2440 | 220.00 | 10 |
| 2612 | HPV | 16 | 5 | 15 | B*5102 | FANIAAFALL | 2441 | 100.00 | 10 |
| 2613 | HPV | 16 | 5 | 15 | Cw*0401 | AFALLVFSTF | 2442 | 100.00 | 10 |
| 2614 | HPV | 16 | 5 | 15 | A*0201 | ALLVFSTFKI | 2443 | 223.89 | 10 |
| 2615 | HPV | 16 | 5 | 15 | A*0201 | LVFSTFKIFV | 2444 | 800.05 | 10 |
| 2616 | HPV | 16 | 5 | 15 | A*0201 | KIFVSGVWHI | 2445 | 320.45 | 10 |
| 2617 | HPV | 16 | 5 | 16 | B*2705 | NRWGTQFL | 2566 | 10000.00 | 8 |
| 2618 | HPV | 16 | 5 | 16 | B*2705 | TQFLVCPL | 2567 | 1000.00 | 8 |
| 2619 | HPV | 16 | 5 | 16 | B*2702 | NRWGTQFLV | 2568 | 100.00 | 9 |
| 2620 | HPV | 16 | 5 | 16 | B*2705 | NRWGTQFLV | 2568 | 3000.00 | 9 |
| 2621 | HPV | 16 | 5 | 16 | B*2705 | TQFLVCPLT | 2569 | 100.00 | 9 |
| 2622 | HPV | 16 | 5 | 16 | A*0201 | FLVCPLTGL | 2570 | 226.01 | 9 |
| 2623 | HPV | 16 | 5 | 16 | Cw*0301 | TGLPKYECL | 2571 | 500.00 | 9 |
| 2624 | HPV | 16 | 5 | 16 | B*5102 | LPKYECLRV | 2572 | 200.00 | 9 |
| 2625 | HPV | 16 | 5 | 16 | A24 | KYECLRVCF | 2573 | 360.00 | 9 |
| 2626 | HPV | 16 | 5 | 16 | Cw*0401 | KYECLRVCF | 2573 | 100.00 | 9 |
| 2627 | HPV | 16 | 5 | 16 | B60 | SENRWGTQFL | 2574 | 160.00 | 10 |
| 2628 | HPV | 16 | 5 | 16 | B*2702 | NRWGTQFLVC | 2575 | 100.00 | 10 |
| 2629 | HPV | 16 | 5 | 16 | B*2705 | NRWGTQFLVC | 2575 | 1000.00 | 10 |
| 2630 | HPV | 16 | 5 | 16 | Cw*0401 | QFLVCPLTGL | 2576 | 400.00 | 10 |
| 2631 | HPV | 16 | 5 | 16 | A68.1 | LVCPLTGLPK | 2577 | 180.00 | 10 |
| 2632 | HPV | 16 | 5 | 17 | B*2705 | LLFVQMSL | 2578 | 150.00 | 8 |
| 2633 | HPV | 16 | 5 | 17 | B*2705 | VQMSLLFF | 2579 | 100.00 | 8 |
| 2634 | HPV | 16 | 5 | 17 | B*2705 | FRTQWLLT | 2580 | 200.00 | 8 |
| 2635 | HPV | 16 | 5 | 17 | B*2705 | TQWLLTVN | 2581 | 100.00 | 8 |
| 2636 | HPV | 16 | 5 | 17 | A*0201 | LLFVQMSLL | 2582 | 309.05 | 9 |
| 2637 | HPV | 16 | 5 | 17 | B*2705 | LLFVQMSLL | 2582 | 150.00 | 9 |
| 2638 | HPV | 16 | 5 | 17 | Cw*0401 | LFVQMSLLF | 2583 | 110.00 | 9 |
| 2639 | HPV | 16 | 5 | 17 | B*2705 | VQMSLLFFR | 2584 | 100.00 | 9 |
| 2640 | HPV | 16 | 5 | 17 | A*0201 | LLFFRTQWL | 2585 | 739.03 | 9 |
| 2641 | HPV | 16 | 5 | 17 | B*2705 | LLFFRTQWL | 2585 | 150.00 | 9 |
| 2642 | HPV | 16 | 5 | 17 | Cw*0401 | LFFRTQWLL | 2586 | 240.00 | 9 |
| 2643 | HPV | 16 | 5 | 17 | B*2705 | FRTQWLLTV | 2587 | 600.00 | 9 |
| 2644 | HPV | 16 | 5 | 17 | B*2705 | TQWLLTVNT | 2588 | 100.00 | 9 |
| 2645 | HPV | 16 | 5 | 17 | A*0201 | SLLFVQMSLL | 2589 | 181.79 | 10 |
| 2646 | HPV | 16 | 5 | 17 | Cw*0401 | LFVQMSLLFF | 2590 | 200.00 | 10 |
| 2647 | HPV | 16 | 5 | 17 | A68.1 | FVQMSLLFFR | 2591 | 200.00 | 10 |
| 2648 | HPV | 16 | 5 | 17 | B*5801 | MSLLFFRTQW | 2592 | 120.00 | 10 |
| 2649 | HPV | 16 | 5 | 17 | A*0201 | SLLFFRTQWL | 2593 | 434.72 | 10 |
| 2650 | HPV | 16 | 5 | 17 | A*0201 | LLFFRTQWLL | 2594 | 1007.77 | 10 |

TABLE 7-continued

| No | Species | Strain type | Frame | ORF | HLA | Seq | Seq ID No. | Score | Length |
|---|---|---|---|---|---|---|---|---|---|
| 2651 | HPV | 16 | 5 | 17 | B*2705 | LLFFRTQWLL | 2594 | 150.00 | 10 |
| 2652 | HPV | 16 | 5 | 17 | B*2705 | FRTQWLLTVN | 2595 | 200.00 | 10 |
| 2653 | HPV | 16 | 5 | 18 | A*0201 | ILTNFRIKL | 2596 | 138.00 | 9 |
| 2654 | HPV | 16 | 5 | 20 | B*5102 | FGYALSFI | 2492 | 800.00 | 8 |
| 2655 | HPV | 16 | 5 | 20 | B*5102 | YALSFIHEL | 2494 | 330.00 | 9 |
| 2656 | HPV | 16 | 5 | 20 | B62 | ILTGFGSTDF | 2496 | 149.76 | 10 |
| 2657 | HPV | 16 | 5 | 20 | B*3701 | TDFGYALSFI | 2497 | 200.00 | 10 |
| 2658 | HPV | 16 | 5 | 20 | Cw*0401 | GYALSFIHEL | 2498 | 400.00 | 10 |
| 2659 | HPV | 16 | 5 | 20 | A24 | GYALSFIHEL | 2498 | 220.00 | 10 |
| 2660 | HPV | 16 | 5 | 20 | B*5102 | YALSFIHELL | 2499 | 330.00 | 10 |
| 2661 | HPV | 16 | 6 | 1 | B*2705 | LQNIVYIK | 2597 | 200.00 | 8 |
| 2662 | HPV | 16 | 6 | 1 | B*2705 | KQDVANIV | 2598 | 180.00 | 8 |
| 2663 | HPV | 16 | 6 | 1 | B*5103 | LALQNIVYI | 2599 | 175.69 | 9 |
| 2664 | HPV | 16 | 6 | 1 | B*5102 | LALQNIVYI | 2599 | 878.46 | 9 |
| 2665 | HPV | 16 | 6 | 1 | A3 | ALQNIVYIK | 2600 | 270.00 | 9 |
| 2666 | HPV | 16 | 6 | 1 | B*2705 | KQKQDVANI | 2601 | 180.00 | 9 |
| 2667 | HPV | 16 | 6 | 1 | B*2705 | KQDVANIVY | 2602 | 300.00 | 9 |
| 2668 | HPV | 16 | 6 | 1 | B*2705 | KQKQDVANIV | 2603 | 180.00 | 10 |
| 2669 | HPV | 16 | 6 | 1 | B*5201 | KQKQDVANIV | 2603 | 200.00 | 10 |
| 2670 | HPV | 16 | 6 | 1 | B*2705 | KQDVANIVYI | 2604 | 180.00 | 10 |
| 2671 | HPV | 16 | 6 | 2 | B*2705 | KTFPLNLL | 2605 | 150.00 | 8 |
| 2672 | HPV | 16 | 6 | 2 | A68.1 | LVVKICVLK | 2606 | 240.00 | 9 |
| 2673 | HPV | 16 | 6 | 2 | B*2705 | LQKTFPLNL | 2607 | 200.00 | 9 |
| 2674 | HPV | 16 | 6 | 2 | B*2705 | LQKTFPLNLL | 2608 | 200.00 | 10 |
| 2675 | HPV | 16 | 6 | 2 | B*2705 | KTFPLNLLPK | 2609 | 150.00 | 10 |
| 2676 | HPV | 16 | 6 | 2 | B*5102 | FPLNLLPKKC | 2610 | 145.20 | 10 |
| 2677 | HPV | 16 | 6 | 3 | B*2705 | LQTYKYLL | 2611 | 200.00 | 8 |
| 2678 | HPV | 16 | 6 | 3 | Cw*0401 | VFDKQLPGL | 2612 | 600.00 | 9 |
| 2679 | HPV | 16 | 6 | 3 | B*2705 | KQLPGLQTY | 2613 | 300.00 | 9 |
| 2680 | HPV | 16 | 6 | 3 | B62 | KQLPGLQTY | 2613 | 211.20 | 9 |
| 2681 | HPV | 16 | 6 | 3 | A24 | TYKYLLVCL | 2614 | 240.00 | 9 |
| 2682 | HPV | 16 | 6 | 3 | Cw*0401 | TYKYLLVCL | 2614 | 400.00 | 9 |
| 2683 | HPV | 16 | 6 | 3 | B60 | LEVYVFDKQL | 2615 | 352.00 | 10 |
| 2684 | HPV | 16 | 6 | 3 | A*0201 | YVFDKQLPGL | 2616 | 300.01 | 10 |
| 2685 | HPV | 16 | 6 | 3 | A*0205 | YVFDKQLPGL | 2616 | 756.00 | 10 |
| 2686 | HPV | 16 | 6 | 3 | B*2705 | KQLPGLQTYK | 2617 | 600.00 | 10 |
| 2687 | HPV | 16 | 6 | 3 | B*5102 | LPGLQTYKYL | 2618 | 146.41 | 10 |
| 2688 | HPV | 16 | 6 | 3 | A*0201 | GLQTYKYLLV | 2619 | 104.33 | 10 |
| 2689 | HPV | 16 | 6 | 3 | Cw*0401 | TYKYLLVCLL | 2620 | 400.00 | 10 |
| 2690 | HPV | 16 | 6 | 3 | A24 | TYKYLLVCLL | 2620 | 240.00 | 10 |
| 2691 | HPV | 16 | 6 | 3 | A*0201 | YLLVCLLGEV | 2621 | 353.95 | 10 |
| 2692 | HPV | 16 | 6 | 3 | A68.1 | VVDQNSSPPK | 2622 | 120.00 | 10 |
| 2693 | HPV | 16 | 6 | 4 | B*2705 | RLFCTVEK | 2623 | 450.00 | 8 |
| 2694 | HPV | 16 | 6 | 4 | B*2705 | LRLFCTVEK | 2624 | 2000.00 | 9 |
| 2695 | HPV | 16 | 6 | 6 | B*3901 | QHWYMGIL | 2625 | 180.00 | 8 |
| 2696 | HPV | 16 | 6 | 6 | B*5102 | MGILCPSV | 2626 | 132.00 | 8 |
| 2697 | HPV | 16 | 6 | 6 | A*0201 | LMVDNHLDL | 2627 | 107.54 | 9 |
| 2698 | HPV | 16 | 6 | 6 | B*2705 | LQHWYMGIL | 2628 | 200.00 | 9 |
| 2699 | HPV | 16 | 6 | 6 | A*0201 | YMGILCPSV | 2629 | 231.07 | 9 |
| 2700 | HPV | 16 | 6 | 6 | A*0201 | LMVDNHLDLL | 2630 | 121.19 | 10 |
| 2701 | HPV | 16 | 6 | 8 | B*2705 | MRCQENQT | 2631 | 200.00 | 8 |
| 2702 | HPV | 16 | 6 | 8 | B*2702 | MRCQENQTY | 2632 | 200.00 | 9 |
| 2703 | HPV | 16 | 6 | 8 | B*2705 | MRCQENQTY | 2632 | 1000.00 | 9 |
| 2704 | HPV | 16 | 6 | 8 | A24 | TYWGQVNVF | 2633 | 120.00 | 9 |
| 2705 | HPV | 16 | 6 | 8 | Cw*0401 | TYWGQVNVF | 2633 | 200.00 | 9 |
| 2706 | HPV | 16 | 6 | 8 | B*2702 | MRCQENQTYW | 2634 | 100.00 | 10 |
| 2707 | HPV | 16 | 6 | 8 | B*2705 | MRCQENQTYW | 2634 | 200.00 | 10 |
| 2708 | HPV | 16 | 6 | 9 | B*2705 | LQVVWMFL | 2635 | 200.00 | 8 |
| 2709 | HPV | 16 | 6 | 9 | B*2705 | VQHIHPCL | 2636 | 200.00 | 8 |
| 2710 | HPV | 16 | 6 | 9 | Cw*0401 | MFLHDNICL | 2637 | 200.00 | 9 |
| 2711 | HPV | 16 | 6 | 9 | A*0201 | FLHDNICLC | 2638 | 215.50 | 9 |
| 2712 | HPV | 16 | 6 | 9 | A*0201 | WMFLHDNICL | 2639 | 262.59 | 10 |
| 2713 | HPV | 16 | 6 | 9 | B*2705 | WMFLHDNICL | 2639 | 250.00 | 10 |
| 2714 | HPV | 16 | 6 | 9 | A*0201 | FLHDNICLCV | 2640 | 1311.75 | 10 |
| 2715 | HPV | 16 | 6 | 11 | B*5102 | AGLCKATI | 2641 | 240.00 | 8 |
| 2716 | HPV | 16 | 6 | 11 | B*5102 | YAGLSYVI | 2642 | 440.00 | 8 |
| 2717 | HPV | 16 | 6 | 11 | B*2705 | VRLYNPRR | 2643 | 300.00 | 8 |
| 2718 | HPV | 16 | 6 | 11 | B*2705 | GRDPGMGV | 2644 | 600.00 | 8 |
| 2719 | HPV | 16 | 6 | 11 | B*5102 | DPGMGVLL | 2645 | 110.00 | 8 |
| 2720 | HPV | 16 | 6 | 11 | B*5102 | MGVLLVTV | 2646 | 132.00 | 8 |
| 2721 | HPV | 16 | 6 | 11 | A*0201 | YLMPVRLEV | 2647 | 1183.78 | 9 |
| 2722 | HPV | 16 | 6 | 11 | B14 | VRLEVNAGL | 2648 | 100.00 | 9 |
| 2723 | HPV | 16 | 6 | 11 | B*2705 | VRLEVNAGL | 2648 | 2000.00 | 9 |
| 2724 | HPV | 16 | 6 | 11 | B*5103 | NAGLCKATI | 2649 | 121.00 | 9 |
| 2725 | HPV | 16 | 6 | 11 | B*5102 | NAGLCKATI | 2649 | 242.00 | 9 |
| 2726 | HPV | 16 | 6 | 11 | A3 | GLCKATISK | 2650 | 120.00 | 9 |

TABLE 7-continued

| No | Species | Strain type | Frame | ORF | HLA | Seq | Seq ID No. | Score | Length |
|---|---|---|---|---|---|---|---|---|---|
| 2727 | HPV | 16 | 6 | 11 | B*5102 | GAILILLSL | 2651 | 165.00 | 9 |
| 2728 | HPV | 16 | 6 | 11 | B62 | ILLSLLEKY | 2652 | 104.00 | 9 |
| 2729 | HPV | 16 | 6 | 11 | A*0201 | SLLEKYNVL | 2653 | 199.30 | 9 |
| 2730 | HPV | 16 | 6 | 11 | A*0205 | SLLEKYNVL | 2653 | 126.00 | 9 |
| 2731 | HPV | 16 | 6 | 11 | Cw*0301 | SLLEKYNVL | 2653 | 150.00 | 9 |
| 2732 | HPV | 16 | 6 | 11 | A24 | KYNVLSTSI | 2654 | 180.00 | 9 |
| 2733 | HPV | 16 | 6 | 11 | Cw*0301 | TSIPSYAGL | 2655 | 500.00 | 9 |
| 2734 | HPV | 16 | 6 | 11 | A*0201 | GLSYVISLV | 2656 | 159.97 | 9 |
| 2735 | HPV | 16 | 6 | 11 | A68.1 | TTLTCCVVR | 2657 | 100.00 | 9 |
| 2736 | HPV | 16 | 6 | 11 | A68.1 | CVVRLYNPR | 2658 | 400.00 | 9 |
| 2737 | HPV | 16 | 6 | 11 | A68.1 | VVRLYNPRR | 2659 | 200.00 | 9 |
| 2738 | HPV | 16 | 6 | 11 | B*2705 | GRDPGMGVL | 2660 | 2000.00 | 9 |
| 2739 | HPV | 16 | 6 | 11 | B*3701 | RDPGMGVLL | 2661 | 200.00 | 9 |
| 2740 | HPV | 16 | 6 | 11 | B*5102 | DPGMGVLLV | 2662 | 220.00 | 9 |
| 2741 | HPV | 16 | 6 | 11 | A*0201 | GMGVLLVTV | 2663 | 115.53 | 9 |
| 2742 | HPV | 16 | 6 | 11 | A*0201 | LLVTVLGFV | 2664 | 194.44 | 9 |
| 2743 | HPV | 16 | 6 | 11 | B*5102 | LGFVLTINV | 2665 | 220.00 | 9 |
| 2744 | HPV | 16 | 6 | 11 | B*2705 | VRLEVNAGLC | 2666 | 200.00 | 10 |
| 2745 | HPV | 16 | 6 | 11 | B*5102 | GAILILLSLL | 2667 | 165.00 | 10 |
| 2746 | HPV | 16 | 6 | 11 | A*0201 | LLSLLEKYNV | 2668 | 118.24 | 10 |
| 2747 | HPV | 16 | 6 | 11 | Cw*0301 | LSLLEKYNVL | 2669 | 100.00 | 10 |
| 2748 | HPV | 16 | 6 | 11 | B*5102 | IPSYAGLSYV | 2670 | 242.00 | 10 |
| 2749 | HPV | 16 | 6 | 11 | B*5102 | YAGLSYVISL | 2671 | 110.00 | 10 |
| 2750 | HPV | 16 | 6 | 11 | B*5102 | AGLSYVISLV | 2672 | 145.20 | 10 |
| 2751 | HPV | 16 | 6 | 11 | A68.1 | CVVRLYNPRR | 2673 | 400.00 | 10 |
| 2752 | HPV | 16 | 6 | 11 | B*2705 | RRATGRDPGM | 2674 | 1800.00 | 10 |
| 2753 | HPV | 16 | 6 | 11 | B*2705 | GRDPGMGVLL | 2675 | 2000.00 | 10 |
| 2754 | HPV | 16 | 6 | 11 | A*0201 | VLLVTVLGFV | 2676 | 719.44 | 10 |
| 2755 | HPV | 16 | 6 | 11 | A*0201 | VLGFVLTINV | 2677 | 118.24 | 10 |
| 2756 | HPV | 16 | 6 | 12 | B*2705 | SRLCFFGA | 2678 | 200.00 | 8 |
| 2757 | HPV | 16 | 6 | 12 | B*2705 | GQVLPNNF | 2679 | 100.00 | 8 |
| 2758 | HPV | 16 | 6 | 12 | B*2705 | FRRGYFVA | 2680 | 200.00 | 8 |
| 2759 | HPV | 16 | 6 | 12 | B*2705 | RRGYFVAA | 2681 | 600.00 | 8 |
| 2760 | HPV | 16 | 6 | 12 | Cw*0401 | FFGAQGDGF | 2682 | 100.00 | 9 |
| 2761 | HPV | 16 | 6 | 12 | B*2705 | GRGGVVGQV | 2683 | 600.00 | 9 |
| 2762 | HPV | 16 | 6 | 12 | B*2705 | GQVLPNNFR | 2679 | 100.00 | 9 |
| 2763 | HPV | 16 | 6 | 12 | A68.1 | QVLPNNFRR | 2684 | 600.00 | 9 |
| 2764 | HPV | 16 | 6 | 12 | B*2705 | FRRGYFVAA | 2685 | 200.00 | 9 |
| 2765 | HPV | 16 | 6 | 12 | B*2705 | RRGYFVAAK | 2686 | 6000.00 | 9 |
| 2766 | HPV | 16 | 6 | 12 | A68.1 | FVAAKHRCR | 2687 | 400.00 | 9 |
| 2767 | HPV | 16 | 6 | 12 | Cw*0401 | CFFGAQGDGF | 2688 | 100.00 | 10 |
| 2768 | HPV | 16 | 6 | 12 | B*2705 | AQGDGFGMGR | 2689 | 100.00 | 10 |
| 2769 | HPV | 16 | 6 | 12 | B*5102 | DGFGMGRGGV | 2690 | 242.00 | 10 |
| 2770 | HPV | 16 | 6 | 12 | B*2705 | GRGGVVGQVL | 2691 | 2000.00 | 10 |
| 2771 | HPV | 16 | 6 | 12 | B*2705 | GQVLPNNFRR | 2692 | 100.00 | 10 |
| 2772 | HPV | 16 | 6 | 12 | B*2705 | FRRGYFVAAK | 2693 | 2000.00 | 10 |
| 2773 | HPV | 16 | 6 | 12 | B*2705 | RRGYFVAAKH | 2694 | 600.00 | 10 |
| 2774 | HPV | 16 | 6 | 13 | B*2705 | TRMNFPYF | 2695 | 1000.00 | 8 |
| 2775 | HPV | 16 | 6 | 13 | B*5102 | FPYFIFTI | 2696 | 4000.00 | 8 |
| 2776 | HPV | 16 | 6 | 13 | B*2705 | TRMNFPYFI | 2697 | 600.00 | 9 |
| 2777 | HPV | 16 | 6 | 13 | B*5201 | FPYFIFTIF | 2698 | 250.00 | 9 |
| 2778 | HPV | 16 | 6 | 13 | A*0201 | FIFTIFFCI | 2699 | 269.06 | 9 |
| 2779 | HPV | 16 | 6 | 13 | Cw*0401 | IFFCIIFKL | 2700 | 440.00 | 9 |
| 2780 | HPV | 16 | 6 | 13 | B*2702 | TRMNFPYFIF | 2701 | 200.00 | 10 |
| 2781 | HPV | 16 | 6 | 13 | B*2705 | TRMNFPYFIF | 2701 | 1000.00 | 10 |
| 2782 | HPV | 16 | 6 | 13 | Cw*0401 | NFPYFIFTIF | 2702 | 100.00 | 10 |
| 2783 | HPV | 16 | 6 | 13 | Cw*0401 | IFTIFFCIIF | 2703 | 100.00 | 10 |
| 2784 | HPV | 16 | 6 | 13 | A*0201 | TIFFCIIFKL | 2704 | 144.98 | 10 |
| 2785 | HPV | 16 | 6 | 14 | Cw*0401 | HFHCISMFF | 2705 | 150.00 | 9 |
| 2786 | HPV | 16 | 6 | 14 | B*5801 | ISMFFYTSCW | 2706 | 120.00 | 10 |
| 2787 | HPV | 16 | 6 | 15 | B*2705 | FRFRQMET | 2707 | 1000.00 | 8 |
| 2788 | HPV | 16 | 6 | 15 | B*2702 | FRFRQMETH | 2708 | 100.00 | 9 |
| 2789 | HPV | 16 | 6 | 15 | B*2705 | FRFRQMETH | 2708 | 1000.00 | 9 |
| 2790 | HPV | 16 | 6 | 18 | B*5102 | NPLQFLPV | 2709 | 660.00 | 8 |
| 2791 | HPV | 16 | 6 | 18 | B*2705 | LQFLPVNY | 2710 | 500.00 | 8 |
| 2792 | HPV | 16 | 6 | 18 | A*0205 | LVYNVYTLL | 2711 | 142.80 | 9 |
| 2793 | HPV | 16 | 6 | 18 | Cw*0301 | LVYNVYTLL | 2711 | 100.00 | 9 |
| 2794 | HPV | 16 | 6 | 18 | A24 | VYTLLHNPL | 2712 | 288.00 | 9 |
| 2795 | HPV | 16 | 6 | 18 | Cw*0401 | VYTLLHNPL | 2712 | 200.00 | 9 |
| 2796 | HPV | 16 | 6 | 18 | A*0201 | LLHNPLQFL | 2713 | 459.40 | 9 |
| 2797 | HPV | 16 | 6 | 18 | B*2702 | LQFLPVNYF | 2714 | 100.00 | 9 |
| 2798 | HPV | 16 | 6 | 18 | B*2705 | LQFLPVNYF | 2714 | 500.00 | 9 |
| 2799 | HPV | 16 | 6 | 18 | Cw*0301 | QFLPVNYFL | 2715 | 100.00 | 9 |
| 2800 | HPV | 16 | 6 | 18 | Cw*0401 | QFLPVNYFL | 2715 | 240.00 | 9 |
| 2801 | HPV | 16 | 6 | 18 | Cw*0301 | LLVYNVYTLL | 2716 | 100.00 | 10 |
| 2802 | HPV | 16 | 6 | 18 | A*0201 | TLLHNPLQFL | 2717 | 999.87 | 10 |

TABLE 7-continued

| No | Species | Strain type | Frame | ORF | HLA | Seq | Seq ID No. | Score | Length |
|---|---|---|---|---|---|---|---|---|---|
| 2803 | HPV | 16 | 6 | 18 | B*2705 | LQFLPVNYFL | 2718 | 1000.00 | 10 |
| 2804 | HPV | 16 | 6 | 18 | B*5201 | LQFLPVNYFL | 2718 | 130.68 | 10 |
| 2805 | HPV | 16 | 6 | 19 | B*2705 | MQFHYRLL | 2719 | 1000.00 | 8 |
| 2806 | HPV | 16 | 6 | 19 | B*2705 | YRLLCHYR | 2720 | 1000.00 | 8 |
| 2807 | HPV | 16 | 6 | 19 | B*2705 | YRRPIVPS | 2721 | 200.00 | 8 |
| 2808 | HPV | 16 | 6 | 19 | B*2705 | RRPIVPSV | 2722 | 1800.00 | 8 |
| 2809 | HPV | 16 | 6 | 19 | B*5102 | RPIVPSVI | 2723 | 1200.00 | 8 |
| 2810 | HPV | 16 | 6 | 19 | A24 | IYMQFHYRL | 2724 | 300.00 | 9 |
| 2811 | HPV | 16 | 6 | 19 | Cw*0401 | IYMQFHYRL | 2724 | 200.00 | 9 |
| 2812 | HPV | 16 | 6 | 19 | B*2705 | MQFHYRLLC | 2725 | 100.00 | 9 |
| 2813 | HPV | 16 | 6 | 19 | B*2705 | YRLLCHYRR | 2726 | 1000.00 | 9 |
| 2814 | HPV | 16 | 6 | 19 | B*2705 | YRRPIVPSV | 2727 | 600.00 | 9 |
| 2815 | HPV | 16 | 6 | 19 | B*2702 | RRPIVPSVI | 2728 | 180.00 | 9 |
| 2816 | HPV | 16 | 6 | 19 | B*2705 | RRPIVPSVI | 2728 | 1800.00 | 9 |
| 2817 | HPV | 16 | 6 | 19 | B*5201 | RPIVPSVII | 2729 | 132.00 | 9 |
| 2818 | HPV | 16 | 6 | 19 | B*5102 | RPIVPSVII | 2729 | 1200.00 | 9 |
| 2819 | HPV | 16 | 6 | 19 | Cw*0301 | IYMQFHYRLL | 2730 | 100.00 | 10 |
| 2820 | HPV | 16 | 6 | 19 | Cw*0401 | IYMQFHYRLL | 2730 | 220.00 | 10 |
| 2821 | HPV | 16 | 6 | 19 | A24 | IYMQFHYRLL | 2730 | 300.00 | 10 |
| 2822 | HPV | 16 | 6 | 19 | B*2705 | MQFHYRLLCH | 2731 | 100.00 | 10 |
| 2823 | HPV | 16 | 6 | 19 | B*2705 | YRRPIVPSVI | 2732 | 600.00 | 10 |
| 2824 | HPV | 16 | 6 | 19 | B*2702 | RRPIVPSVII | 2733 | 180.00 | 10 |
| 2825 | HPV | 16 | 6 | 19 | B*2705 | RRPIVPSVII | 2733 | 1800.00 | 10 |
| 2826 | HPV | 16 | 6 | 20 | Cw*0401 | VFVSILACL | 2734 | 480.00 | 9 |
| 2827 | HPV | 16 | 6 | 20 | A*0205 | FVFVSILACL | 2735 | 252.00 | 10 |
| 2828 | HPV | 16 | 6 | 21 | B*5102 | EALSSYTL | 2736 | 150.00 | 8 |
| 2829 | HPV | 16 | 6 | 21 | Cw*0401 | LFYTNIMLL | 2737 | 400.00 | 9 |
| 2830 | HPV | 16 | 6 | 21 | A24 | FYTNIMLLL | 2738 | 280.00 | 9 |
| 2831 | HPV | 16 | 6 | 21 | Cw*0401 | FYTNIMLLL | 2738 | 240.00 | 9 |
| 2832 | HPV | 16 | 6 | 21 | Cw*0301 | MLLLYYAIL | 2739 | 100.00 | 9 |
| 2833 | HPV | 16 | 6 | 21 | A24 | LYYAILEAL | 2740 | 280.00 | 9 |
| 2834 | HPV | 16 | 6 | 21 | Cw*0401 | LYYAILEAL | 2740 | 400.00 | 9 |
| 2835 | HPV | 16 | 6 | 21 | B60 | LEALSSYTL | 2741 | 640.00 | 9 |
| 2836 | HPV | 16 | 6 | 21 | Cw*0401 | LFYTNIMLLL | 2742 | 240.00 | 10 |
| 2837 | HPV | 16 | 6 | 21 | Cw*0301 | IMLLLYYAIL | 2743 | 100.00 | 10 |
| 2838 | HPV | 16 | 6 | 21 | A*0201 | LLYYAILEAL | 2744 | 130.97 | 10 |
| 2839 | HPV | 16 | 6 | 21 | B*2705 | LLYYAILEAL | 2744 | 150.00 | 10 |
| 2840 | HPV | 16 | 6 | 23 | B*2705 | QRMCCLCF | 2745 | 1000.00 | 8 |
| 2841 | HPV | 16 | 6 | 23 | A3 | MLFCFLCSK | 2746 | 450.00 | 9 |
| 2842 | HPV | 16 | 6 | 23 | B*2705 | MLFCFLCSK | 2746 | 150.00 | 9 |
| 2843 | HPV | 16 | 6 | 23 | Cw*0401 | CFLCSKQRM | 2747 | 100.00 | 9 |
| 2844 | HPV | 16 | 6 | 23 | B*2705 | KQRMCCLCF | 2748 | 300.00 | 9 |
| 2845 | HPV | 16 | 6 | 23 | B62 | KQRMCCLCF | 2748 | 288.00 | 9 |
| 2846 | HPV | 16 | 6 | 23 | B*2705 | QRMCCLCFC | 2749 | 200.00 | 9 |
| 2847 | HPV | 16 | 6 | 23 | B*2705 | RMCCLCFCL | 2750 | 150.00 | 9 |
| 2848 | HPV | 16 | 6 | 23 | Cw*0401 | LYCISMLFCF | 2751 | 220.00 | 10 |
| 2849 | HPV | 16 | 6 | 23 | A24 | LYCISMLFCF | 2751 | 100.00 | 10 |
| 2850 | HPV | 16 | 6 | 23 | Cw*0301 | YCISMLFCFL | 2752 | 100.00 | 10 |
| 2851 | HPV | 16 | 6 | 23 | A3 | SMLFCFLCSK | 2753 | 135.00 | 10 |
| 2852 | HPV | 16 | 6 | 23 | B*2705 | QRMCCLCFCL | 2754 | 2000.00 | 10 |
| 2853 | HPV | 16 | 6 | 24 | B*2705 | LRTDGAHN | 2755 | 200.00 | 8 |
| 2854 | HPV | 16 | 6 | 24 | B*2705 | LRTDGAHNS | 2756 | 200.00 | 9 |
| 2855 | HPV | 16 | 6 | 25 | B*2705 | HRPVHRPL | 2757 | 2000.00 | 8 |
| 2856 | HPV | 16 | 6 | 25 | B*5102 | RPVHRPLI | 2758 | 1320.00 | 8 |
| 2857 | HPV | 16 | 6 | 25 | B*2705 | HRPLILWN | 2759 | 200.00 | 8 |
| 2858 | HPV | 16 | 6 | 25 | B*5102 | RPLILWNL | 2760 | 300.00 | 8 |
| 2859 | HPV | 16 | 6 | 25 | B*2705 | ILWNLCFL | 2761 | 150.00 | 8 |
| 2860 | HPV | 16 | 6 | 25 | B*2705 | SRCLCFSS | 2762 | 200.00 | 8 |
| 2861 | HPV | 16 | 6 | 25 | B14 | HRPVHRPLI | 2763 | 120.00 | 9 |
| 2862 | HPV | 16 | 6 | 25 | B*2705 | HRPVHRPLI | 2763 | 600.00 | 9 |
| 2863 | HPV | 16 | 6 | 25 | B*5102 | RPVHRPLIL | 2764 | 330.00 | 9 |
| 2864 | HPV | 16 | 6 | 25 | B14 | HRPLILWNL | 2765 | 120.00 | 9 |
| 2865 | HPV | 16 | 6 | 25 | B*2705 | HRPLILWNL | 2765 | 2000.00 | 9 |
| 2866 | HPV | 16 | 6 | 25 | A*0201 | LILWNLCFL | 2766 | 233.72 | 9 |
| 2867 | HPV | 16 | 6 | 25 | Cw*0401 | CFLSRCLCF | 2767 | 110.00 | 9 |
| 2868 | HPV | 16 | 6 | 25 | Cw*0401 | CFSSGHSGF | 2768 | 100.00 | 9 |
| 2869 | HPV | 16 | 6 | 25 | B*2705 | QQDIHRPVHR | 2769 | 100.00 | 10 |
| 2870 | HPV | 16 | 6 | 25 | B14 | HRPVHRPLIL | 2770 | 400.00 | 10 |
| 2871 | HPV | 16 | 6 | 25 | B*2705 | HRPVHRPLIL | 2770 | 2000.00 | 10 |
| 2872 | HPV | 16 | 6 | 25 | B*2705 | HRPLILWNLC | 2771 | 200.00 | 10 |
| 2873 | HPV | 16 | 6 | 25 | A3 | ILWNLCFLSR | 2772 | 120.00 | 10 |
| 2874 | HPV | 16 | 6 | 25 | B*2705 | SRCLCFSSGH | 2773 | 200.00 | 10 |
| 2875 | HPV | 16 | 6 | 1 | B*2705 | NRDLARMA | 2774 | 200.00 | 8 |
| 2876 | HPV | 16 | 6 | 1 | B*2705 | ARMASRKR | 2775 | 300.00 | 8 |
| 2877 | HPV | 16 | 6 | 1 | B*2705 | SRKRTSLN | 2776 | 200.00 | 8 |
| 2878 | HPV | 16 | 6 | 1 | B*2705 | KRTSLNHS | 2777 | 600.00 | 8 |

TABLE 7-continued

| No | Species | Strain type | Frame | ORF | HLA | Seq | Seq ID No. | Score | Length |
|---|---|---|---|---|---|---|---|---|---|
| 2879 | HPV | 16 | 6 | 1 | B*2705 | GQENRDLAR | 2778 | 100.00 | 9 |
| 2880 | HPV | 16 | 6 | 1 | B*2705 | NRDLARMAS | 2779 | 200.00 | 9 |
| 2881 | HPV | 16 | 6 | 1 | B*2705 | SRKRTSLNH | 2780 | 200.00 | 9 |
| 2882 | HPV | 16 | 6 | 1 | B*2705 | KRTSLNHSC | 2781 | 600.00 | 9 |
| 2883 | HPV | 16 | 6 | 1 | B*2705 | NRDLARMASR | 2782 | 1000.00 | 10 |
| 2884 | HPV | 16 | 6 | 1 | B*2705 | RMASRKRTSL | 2783 | 150.00 | 10 |
| 2885 | HPV | 16 | 6 | 1 | B*2705 | SRKRTSLNHS | 2784 | 200.00 | 10 |
| 2886 | HPV | 16 | 6 | 2 | B*5102 | MGLALQNI | 2785 | 264.00 | 8 |
| 2887 | HPV | 16 | 6 | 2 | B*2705 | LQNIVYIK | 2597 | 200.00 | 8 |
| 2888 | HPV | 16 | 6 | 2 | B*2705 | KQDVANIV | 2598 | 180.00 | 8 |
| 2889 | HPV | 16 | 6 | 2 | B*5201 | MGLALQNIV | 2786 | 360.00 | 9 |
| 2890 | HPV | 16 | 6 | 2 | B*5102 | MGLALQNIV | 2786 | 132.00 | 9 |
| 2891 | HPV | 16 | 6 | 2 | B*5103 | LALQNIVYI | 2599 | 175.69 | 9 |
| 2892 | HPV | 16 | 6 | 2 | B*5102 | LALQNIVYI | 2599 | 878.46 | 9 |
| 2893 | HPV | 16 | 6 | 2 | A3 | ALQNIVYIK | 2600 | 270.00 | 9 |
| 2894 | HPV | 16 | 6 | 2 | B*2705 | KQKQDVANI | 2601 | 180.00 | 9 |
| 2895 | HPV | 16 | 6 | 2 | B*2705 | KQDVANIVY | 2602 | 300.00 | 9 |
| 2896 | HPV | 16 | 6 | 2 | A*0201 | GLALQNIVYI | 2787 | 131.97 | 10 |
| 2897 | HPV | 16 | 6 | 2 | B*2705 | KQKQDVANIV | 2603 | 180.00 | 10 |
| 2898 | HPV | 16 | 6 | 2 | B*5201 | KQKQDVANIV | 2603 | 200.00 | 10 |
| 2899 | HPV | 16 | 6 | 2 | B*2705 | KQDVANIVYI | 2604 | 180.00 | 10 |
| 2900 | HPV | 16 | 6 | 3 | B*2705 | TQAFKNTY | 2788 | 100.00 | 8 |
| 2901 | HPV | 16 | 6 | 3 | B*2705 | TRVYYTIH | 2789 | 200.00 | 8 |
| 2902 | HPV | 16 | 6 | 3 | A68.1 | DTIVTQAFK | 2790 | 180.00 | 9 |
| 2903 | HPV | 16 | 6 | 3 | B*2705 | TRVYYTIHT | 2791 | 200.00 | 9 |
| 2904 | HPV | 16 | 6 | 3 | B*3801 | LHDTIVTQAF | 2792 | 117.00 | 10 |
| 2905 | HPV | 16 | 6 | 3 | B*2705 | TQAFKNTYTR | 2793 | 100.00 | 10 |
| 2906 | HPV | 16 | 6 | 3 | B*5102 | QAFKNTYTRV | 2794 | 1210.00 | 10 |
| 2907 | HPV | 16 | 6 | 3 | B*5103 | QAFKNTYTRV | 2794 | 120.00 | 10 |
| 2908 | HPV | 16 | 6 | 3 | B*2705 | TRVYYTIHTN | 2795 | 200.00 | 10 |
| 2909 | HPV | 16 | 6 | 4 | Cw*0401 | MYKYPVELHF | 2796 | 110.00 | 10 |
| 2910 | HPV | 16 | 6 | 4 | A24 | MYKYPVELHF | 2796 | 140.00 | 10 |
| 2911 | HPV | 16 | 6 | 5 | B*3901 | QHWYMGIL | 2625 | 180.00 | 8 |
| 2912 | HPV | 16 | 6 | 5 | B*5102 | MGILCPSV | 2626 | 132.00 | 8 |
| 2913 | HPV | 16 | 6 | 5 | B*2705 | LQHWYMGIL | 2628 | 200.00 | 9 |
| 2914 | HPV | 16 | 6 | 5 | A*0201 | YMGILCPSV | 2629 | 231.07 | 9 |
| 2915 | HPV | 16 | 6 | 6 | B*3901 | DHDLPQHL | 2797 | 270.00 | 8 |
| 2916 | HPV | 16 | 6 | 6 | B*2705 | HRPKPAAV | 2798 | 600.00 | 8 |
| 2917 | HPV | 16 | 6 | 6 | B*3501 | RPKPAAVY | 2799 | 240.00 | 8 |
| 2918 | HPV | 16 | 6 | 6 | B*2705 | MRCQENQT | 2630 | 200.00 | 8 |
| 2919 | HPV | 16 | 6 | 6 | B*2702 | HRPKPAAVY | 2800 | 200.00 | 9 |
| 2920 | HPV | 16 | 6 | 6 | B*2705 | HRPKPAAVY | 2800 | 1000.00 | 9 |
| 2921 | HPV | 16 | 6 | 6 | Cw*0401 | RPKPAAVYL | 2801 | 105.60 | 9 |
| 2922 | HPV | 16 | 6 | 6 | B*3501 | RPKPAAVYL | 2801 | 120.00 | 9 |
| 2923 | HPV | 16 | 6 | 6 | Cw*0702 | KPAAVYLDY | 2802 | 115.20 | 9 |
| 2924 | HPV | 16 | 6 | 6 | A68.1 | AVYLDYKMR | 2803 | 200.00 | 9 |
| 2925 | HPV | 16 | 6 | 6 | B*2702 | MRCQENQTY | 2632 | 200.00 | 9 |
| 2926 | HPV | 16 | 6 | 6 | B*2705 | MRCQENQTY | 2632 | 1000.00 | 9 |
| 2927 | HPV | 16 | 6 | 6 | A24 | TYWGQVNVF | 2632 | 120.00 | 9 |
| 2928 | HPV | 16 | 6 | 6 | Cw*0401 | TYWGQVNVF | 2632 | 200.00 | 9 |
| 2929 | HPV | 16 | 6 | 6 | B*2705 | HRPKPAAVYL | 2804 | 2000.00 | 10 |
| 2930 | HPV | 16 | 6 | 6 | B*2702 | MRCQENQTYW | 2634 | 100.00 | 10 |
| 2931 | HPV | 16 | 6 | 6 | B*2705 | MRCQENQTYW | 2634 | 200.00 | 10 |
| 2932 | HPV | 16 | 6 | 7 | B*2705 | VQHIHPCL | 2636 | 200.00 | 8 |
| 2933 | HPV | 16 | 6 | 7 | Cw*0401 | MFLHDNICL | 2637 | 200.00 | 9 |
| 2934 | HPV | 16 | 6 | 7 | A*0201 | FLHDNICLC | 2638 | 215.50 | 9 |
| 2935 | HPV | 16 | 6 | 7 | A*0201 | FLHDNICLCV | 2640 | 1311.75 | 10 |
| 2936 | HPV | 16 | 6 | 8 | B*5102 | YAPPKGIV | 2805 | 200.00 | 8 |
| 2937 | HPV | 16 | 6 | 8 | B*5102 | APPKGIVV | 2806 | 266.20 | 8 |
| 2938 | HPV | 16 | 6 | 8 | B*5103 | YAPPKGIVV | 2807 | 100.00 | 9 |
| 2939 | HPV | 16 | 6 | 8 | B*5102 | YAPPKGIVV | 2807 | 200.00 | 9 |
| 2940 | HPV | 16 | 6 | 8 | B*5102 | KGIVVFAGI | 2808 | 264.00 | 9 |
| 2941 | HPV | 16 | 6 | 9 | B*5102 | AGLCKATI | 2641 | 240.00 | 8 |
| 2942 | HPV | 16 | 6 | 9 | B*5102 | YAGLSYVI | 2642 | 440.00 | 8 |
| 2943 | HPV | 16 | 6 | 9 | B*2705 | VRLYNPRR | 2643 | 300.00 | 8 |
| 2944 | HPV | 16 | 6 | 9 | B*2705 | GRDPGMGV | 2644 | 600.00 | 8 |
| 2945 | HPV | 16 | 6 | 9 | B*5102 | DPGMGVLL | 2645 | 110.00 | 8 |
| 2946 | HPV | 16 | 6 | 9 | B*5102 | MGVLLVTV | 2646 | 132.00 | 8 |
| 2947 | HPV | 16 | 6 | 9 | B14 | VRLEVNAGL | 2648 | 100.00 | 9 |
| 2948 | HPV | 16 | 6 | 9 | B*2705 | VRLEVNAGL | 2648 | 2000.00 | 9 |
| 2949 | HPV | 16 | 6 | 9 | B*5103 | NAGLCKATI | 2649 | 121.00 | 9 |
| 2950 | HPV | 16 | 6 | 9 | B*5102 | NAGLCKATI | 2649 | 242.00 | 9 |
| 2951 | HPV | 16 | 6 | 9 | A3 | GLCKATISK | 2650 | 120.00 | 9 |
| 2952 | HPV | 16 | 6 | 9 | B*5102 | GAILILLSL | 2651 | 165.00 | 9 |
| 2953 | HPV | 16 | 6 | 9 | B62 | ILLSLLEKY | 2652 | 104.00 | 9 |
| 2954 | HPV | 16 | 6 | 9 | A*0201 | SLLEKYNVL | 2653 | 199.30 | 9 |

TABLE 7-continued

| No | Species | Strain type | Frame | ORF | HLA | Seq | Seq ID No. | Score | Length |
|---|---|---|---|---|---|---|---|---|---|
| 2955 | HPV | 16 | 6 | 9 | A*0205 | SLLEKYNVL | 2653 | 126.00 | 9 |
| 2956 | HPV | 16 | 6 | 9 | Cw*0301 | SLLEKYNVL | 2653 | 150.00 | 9 |
| 2957 | HPV | 16 | 6 | 9 | A24 | KYNVLSTSI | 2654 | 180.00 | 9 |
| 2958 | HPV | 16 | 6 | 9 | Cw*0301 | TSIPSYAGL | 2655 | 500.00 | 9 |
| 2959 | HPV | 16 | 6 | 9 | A*0201 | GLSYVISLV | 2656 | 159.97 | 9 |
| 2960 | HPV | 16 | 6 | 9 | A68.1 | TTLTCCVVR | 2657 | 100.00 | 9 |
| 2961 | HPV | 16 | 6 | 9 | A68.1 | CVVRLYNPR | 2658 | 400.00 | 9 |
| 2962 | HPV | 16 | 6 | 9 | A68.1 | VVRLYNPRR | 2659 | 200.00 | 9 |
| 2963 | HPV | 16 | 6 | 9 | B*2705 | GRDPGMGVL | 2660 | 2000.00 | 9 |
| 2964 | HPV | 16 | 6 | 9 | B*3701 | RDPGMGVLL | 2661 | 200.00 | 9 |
| 2965 | HPV | 16 | 6 | 9 | B*5102 | DPGMGVLLV | 2662 | 220.00 | 9 |
| 2966 | HPV | 16 | 6 | 9 | A*0201 | GMGVLLVTV | 2663 | 115.53 | 9 |
| 2967 | HPV | 16 | 6 | 9 | A*0201 | LLVTVLGFV | 2664 | 194.44 | 9 |
| 2968 | HPV | 16 | 6 | 9 | B*5102 | LGFVLTINV | 2665 | 220.00 | 9 |
| 2969 | HPV | 16 | 6 | 9 | B*2705 | VRLEVNAGLC | 2666 | 200.00 | 10 |
| 2970 | HPV | 16 | 6 | 9 | B*5102 | GAILILLSLL | 2667 | 165.00 | 10 |
| 2971 | HPV | 16 | 6 | 9 | A*0201 | LLSLLEKYNV | 2668 | 118.24 | 10 |
| 2972 | HPV | 16 | 6 | 9 | Cw*0301 | LSLLEKYNVL | 2669 | 100.00 | 10 |
| 2973 | HPV | 16 | 6 | 9 | B*5102 | IPSYAGLSYV | 2670 | 242.00 | 10 |
| 2974 | HPV | 16 | 6 | 9 | B*5102 | YAGLSYVISL | 2671 | 110.00 | 10 |
| 2975 | HPV | 16 | 6 | 9 | B*5102 | AGLSYVISLV | 2672 | 145.20 | 10 |
| 2976 | HPV | 16 | 6 | 9 | A68.1 | CVVRLYNPRR | 2673 | 400.00 | 10 |
| 2977 | HPV | 16 | 6 | 9 | B*2705 | RRATGRDPGM | 2674 | 1800.00 | 10 |
| 2978 | HPV | 16 | 6 | 9 | B*2705 | GRDPGMGVLL | 2675 | 2000.00 | 10 |
| 2979 | HPV | 16 | 6 | 9 | A*0201 | VLLVTVLGFV | 2676 | 719.44 | 10 |
| 2980 | HPV | 16 | 6 | 9 | A*0201 | VLGFVLTINV | 2677 | 118.24 | 10 |
| 2981 | HPV | 16 | 6 | 10 | B*5102 | APASIKLV | 2809 | 200.00 | 8 |
| 2982 | HPV | 16 | 6 | 10 | B*5102 | GGLTGASV | 2810 | 145.20 | 8 |
| 2983 | HPV | 16 | 6 | 10 | B*5102 | GASVSVAV | 2811 | 100.00 | 8 |
| 2984 | HPV | 16 | 6 | 10 | B*5102 | GGLVPNGI | 2812 | 264.00 | 8 |
| 2985 | HPV | 16 | 6 | 10 | B*5102 | VPNGIYPV | 2813 | 220.00 | 8 |
| 2986 | HPV | 16 | 6 | 10 | B*5102 | RPPVPDPV | 2814 | 200.00 | 8 |
| 2987 | HPV | 16 | 6 | 10 | B*5102 | NPPKNTPI | 2815 | 532.40 | 8 |
| 2988 | HPV | 16 | 6 | 10 | B*5102 | VPACLHVL | 2816 | 100.00 | 8 |
| 2989 | HPV | 16 | 6 | 10 | A68.1 | DVGAPASIK | 2817 | 720.00 | 9 |
| 2990 | HPV | 16 | 6 | 10 | B*5103 | GAPASIKLV | 2818 | 110.00 | 9 |
| 2991 | HPV | 16 | 6 | 10 | B*5102 | GAPASIKLV | 2818 | 121.00 | 9 |
| 2992 | HPV | 16 | 6 | 10 | B*2705 | VRPPVPDPV | 2819 | 600.00 | 9 |
| 2993 | HPV | 16 | 6 | 10 | B*5102 | PPVPDPVPI | 2820 | 120.00 | 9 |
| 2994 | HPV | 16 | 6 | 10 | B*5102 | NPPKNTPIL | 2821 | 133.10 | 9 |
| 2995 | HPV | 16 | 6 | 10 | B*5102 | TPILPYCNI | 2822 | 1320.00 | 9 |
| 2996 | HPV | 16 | 6 | 10 | B*5102 | SAIVLPSTL | 2823 | 165.00 | 9 |
| 2997 | HPV | 16 | 6 | 10 | B*5102 | LGIMSGGHV | 2824 | 120.00 | 9 |
| 2998 | HPV | 16 | 6 | 10 | B*5102 | GGLTGASVSV | 2825 | 132.00 | 10 |
| 2999 | HPV | 16 | 6 | 10 | A*0201 | GLVPNGIYPV | 2826 | 159.97 | 10 |
| 3000 | HPV | 16 | 6 | 10 | A68.1 | LVPNGIYPVR | 2827 | 200.00 | 10 |
| 3001 | HPV | 16 | 6 | 10 | B*5102 | NGIYPVRPPV | 2828 | 132.00 | 10 |
| 3002 | HPV | 16 | 6 | 10 | B*5102 | RPPVPDPVPI | 2829 | 400.00 | 10 |
| 3003 | HPV | 16 | 6 | 10 | B*5102 | IPNPPKNTPI | 2830 | 440.00 | 10 |
| 3004 | HPV | 16 | 6 | 10 | B*5102 | LPYCNICSAI | 2831 | 2000.00 | 10 |
| 3005 | HPV | 16 | 6 | 10 | B*5103 | LPYCNICSAI | 2831 | 120.00 | 10 |
| 3006 | HPV | 16 | 6 | 10 | B*3901 | GHVPACLHVL | 2832 | 270.00 | 10 |
| 3007 | HPV | 16 | 6 | 10 | Cw*0301 | GHVPACLHVL | 2832 | 100.00 | 10 |
| 3008 | HPV | 16 | 6 | 11 | B*2705 | MQYQDLSY | 2833 | 500.00 | 8 |
| 3009 | HPV | 16 | 6 | 11 | B*2705 | SRHCNSFW | 2834 | 200.00 | 8 |
| 3010 | HPV | 16 | 6 | 11 | B*2705 | LRQKLVTL | 2835 | 2000.00 | 8 |
| 3011 | HPV | 16 | 6 | 11 | B*2705 | RRHCSIQC | 2836 | 600.00 | 8 |
| 3012 | HPV | 16 | 6 | 11 | B*2705 | IQCTMLFK | 2837 | 200.00 | 8 |
| 3013 | HPV | 16 | 6 | 11 | A*0201 | MLWMQYQDL | 2838 | 452.14 | 9 |
| 3014 | HPV | 16 | 6 | 11 | B*2705 | MLWMQYQDL | 2838 | 150.00 | 9 |
| 3015 | HPV | 16 | 6 | 11 | B*2705 | MQYQDLSYR | 2839 | 500.00 | 9 |
| 3016 | HPV | 16 | 6 | 11 | B*5801 | KSSRHCNSF | 2840 | 132.00 | 9 |
| 3017 | HPV | 16 | 6 | 11 | B*2702 | SRHCNSFWY | 2841 | 200.00 | 9 |
| 3018 | HPV | 16 | 6 | 11 | B*2705 | SRHCNSFWY | 2841 | 1000.00 | 9 |
| 3019 | HPV | 16 | 6 | 11 | A24 | WYFNLRQKL | 2842 | 316.80 | 9 |
| 3020 | HPV | 16 | 6 | 11 | Cw*0401 | WYFNLRQKL | 2842 | 220.00 | 9 |
| 3021 | HPV | 16 | 6 | 11 | B8 | NLRQKLVTL | 2843 | 160.00 | 9 |
| 3022 | HPV | 16 | 6 | 11 | B*2705 | RQKLVTLPF | 2844 | 300.00 | 9 |
| 3023 | HPV | 16 | 6 | 11 | B62 | RQKLVTLPF | 2844 | 576.00 | 9 |
| 3024 | HPV | 16 | 6 | 11 | A*0201 | KLVTLPFTI | 2845 | 211.79 | 9 |
| 3025 | HPV | 16 | 6 | 11 | B*5102 | LPFTIICKC | 2846 | 121.00 | 9 |
| 3026 | HPV | 16 | 6 | 11 | Cw*0401 | MFYIMSCPM | 2847 | 110.00 | 9 |
| 3027 | HPV | 16 | 6 | 11 | B*5102 | MPCRRHCSI | 2848 | 440.00 | 9 |
| 3028 | HPV | 16 | 6 | 11 | B*2705 | CRRHCSIQC | 2849 | 200.00 | 9 |
| 3029 | HPV | 16 | 6 | 11 | B*2705 | RRHCSIQCT | 2850 | 600.00 | 9 |
| 3030 | HPV | 16 | 6 | 11 | B*2705 | MQYQDLSYRH | 2851 | 100.00 | 10 |

TABLE 7-continued

| No | Species | Strain type | Frame | ORF | HLA | Seq | Seq ID No. | Score | Length |
|---|---|---|---|---|---|---|---|---|---|
| 3031 | HPV | 16 | 6 | 11 | B*2705 | YRHKSSRHCN | 2852 | 200.00 | 10 |
| 3032 | HPV | 16 | 6 | 11 | B*5801 | KSSRHCNSFW | 2853 | 240.00 | 10 |
| 3033 | HPV | 16 | 6 | 11 | B*2702 | SRHCNSFWYF | 2854 | 200.00 | 10 |
| 3034 | HPV | 16 | 6 | 11 | B*2705 | SRHCNSFWYF | 2854 | 1000.00 | 10 |
| 3035 | HPV | 16 | 6 | 11 | B*2702 | LRQKLVTLPF | 2855 | 200.00 | 10 |
| 3036 | HPV | 16 | 6 | 11 | B*2705 | LRQKLVTLPF | 2855 | 1000.00 | 10 |
| 3037 | HPV | 16 | 6 | 11 | B*2705 | CRRHCSIQCT | 2856 | 200.00 | 10 |
| 3038 | HPV | 16 | 6 | 11 | B*2705 | RRHCSIQCTM | 2857 | 1800.00 | 10 |
| 3039 | HPV | 16 | 6 | 12 | B*5102 | YGCSVTITV | 2858 | 106.48 | 9 |
| 3040 | HPV | 16 | 6 | 13 | B*2705 | GQVLPNNF | 2679 | 100.00 | 8 |
| 3041 | HPV | 16 | 6 | 13 | B*2705 | FRRGYFVA | 2680 | 200.00 | 8 |
| 3042 | HPV | 16 | 6 | 13 | B*2705 | RRGYFVAA | 2681 | 600.00 | 8 |
| 3043 | HPV | 16 | 6 | 13 | B*2705 | GRGGVVGQV | 2683 | 600.00 | 9 |
| 3044 | HPV | 16 | 6 | 13 | B*2705 | GQVLPNNFR | 2679 | 100.00 | 9 |
| 3045 | HPV | 16 | 6 | 13 | A68.1 | QVLPNNFRR | 2684 | 600.00 | 9 |
| 3046 | HPV | 16 | 6 | 13 | B*2705 | FRRGYFVAA | 2685 | 200.00 | 9 |
| 3047 | HPV | 16 | 6 | 13 | B*2705 | RRGYFVAAK | 2686 | 6000.00 | 9 |
| 3048 | HPV | 16 | 6 | 13 | A68.1 | FVAAKHRCR | 2687 | 400.00 | 9 |
| 3049 | HPV | 16 | 6 | 13 | B*2705 | GRGGVVGQVL | 2691 | 2000.00 | 10 |
| 3050 | HPV | 16 | 6 | 13 | B*2705 | GQVLPNNFRR | 2692 | 100.00 | 10 |
| 3051 | HPV | 16 | 6 | 13 | B*2705 | FRRGYFVAAK | 2693 | 2000.00 | 10 |
| 3052 | HPV | 16 | 6 | 13 | B*2705 | RRGYFVAAKH | 2694 | 600.00 | 10 |
| 3053 | HPV | 16 | 6 | 14 | B*5102 | FPYFIFTI | 2696 | 4000.00 | 8 |
| 3054 | HPV | 16 | 6 | 14 | B*5201 | FPYFIFTIF | 2698 | 250.00 | 9 |
| 3055 | HPV | 16 | 6 | 14 | A*0201 | FIFTIFFCI | 2699 | 269.06 | 9 |
| 3056 | HPV | 16 | 6 | 14 | Cw*0401 | IFFCIIFKL | 2700 | 440.00 | 9 |
| 3057 | HPV | 16 | 6 | 14 | Cw*0401 | NFPYFIFTIF | 2702 | 100.00 | 10 |
| 3058 | HPV | 16 | 6 | 14 | Cw*0401 | IFTIFFCIIF | 2703 | 100.00 | 10 |
| 3059 | HPV | 16 | 6 | 14 | A*0201 | TIFFCIIFKL | 2704 | 144.98 | 10 |
| 3060 | HPV | 16 | 6 | 15 | B*5102 | IAYVSIKL | 2859 | 302.50 | 8 |
| 3061 | HPV | 16 | 6 | 15 | B*5102 | CPVCIMHCI | 2860 | 1200.00 | 9 |
| 3062 | HPV | 16 | 6 | 15 | A*0201 | CIMHCIAYV | 2861 | 447.61 | 9 |
| 3063 | HPV | 16 | 6 | 15 | A24 | AYVSIKLHF | 2862 | 210.00 | 9 |
| 3064 | HPV | 16 | 6 | 15 | Cw*0401 | AYVSIKLHF | 2862 | 110.00 | 9 |
| 3065 | HPV | 16 | 6 | 15 | Cw*0401 | HFHCISMFF | 2705 | 150.00 | 9 |
| 3066 | HPV | 16 | 6 | 15 | B*5801 | ISMFFYTSCW | 2706 | 120.00 | 10 |
| 3067 | HPV | 16 | 6 | 16 | Cw*0401 | MFKSHFSGL | 2863 | 220.00 | 9 |
| 3068 | HPV | 16 | 6 | 17 | B*5102 | EGILVVPMV | 2864 | 145.20 | 9 |
| 3069 | HPV | 16 | 6 | 17 | A*0201 | ILVVPMVYA | 2865 | 106.84 | 9 |
| 3070 | HPV | 16 | 6 | 17 | Cw*0301 | LVVPMVYAL | 2866 | 100.00 | 9 |
| 3071 | HPV | 16 | 6 | 18 | B*3901 | MHFLNCHL | 2867 | 180.00 | 8 |
| 3072 | HPV | 16 | 6 | 18 | B*3901 | CHLCSSNRAL | 2868 | 180.00 | 10 |
| 3073 | HPV | 16 | 6 | 20 | B*2705 | MQFHYRLL | 2719 | 1000.00 | 8 |
| 3074 | HPV | 16 | 6 | 20 | B*2705 | YRLLCHYR | 2720 | 1000.00 | 8 |
| 3075 | HPV | 16 | 6 | 20 | B*2705 | YRRPIVPS | 2721 | 200.00 | 8 |
| 3076 | HPV | 16 | 6 | 20 | B*2705 | RRPIVPSV | 2722 | 1800.00 | 8 |
| 3077 | HPV | 16 | 6 | 20 | B*5102 | RPIVPSVI | 2723 | 1200.00 | 8 |
| 3078 | HPV | 16 | 6 | 20 | B*2705 | MQFHYRLLC | 2725 | 100.00 | 9 |
| 3079 | HPV | 16 | 6 | 20 | B*2705 | YRLLCHYRR | 2726 | 1000.00 | 9 |
| 3080 | HPV | 16 | 6 | 20 | B*2705 | YRRPIVPSV | 2727 | 600.00 | 9 |
| 3081 | HPV | 16 | 6 | 20 | B*2702 | RRPIVPSVI | 2728 | 180.00 | 9 |
| 3082 | HPV | 16 | 6 | 20 | B*2705 | RRPIVPSVI | 2728 | 1800.00 | 9 |
| 3083 | HPV | 16 | 6 | 20 | B*5201 | RPIVPSVII | 2729 | 132.00 | 9 |
| 3084 | HPV | 16 | 6 | 20 | B*5102 | RPIVPSVII | 2729 | 1200.00 | 9 |
| 3085 | HPV | 16 | 6 | 20 | B*2705 | MQFHYRLLCH | 2731 | 100.00 | 10 |
| 3086 | HPV | 16 | 6 | 20 | B*2705 | YRRPIVPSVI | 2732 | 600.00 | 10 |
| 3087 | HPV | 16 | 6 | 20 | B*2702 | RRPIVPSVII | 2733 | 180.00 | 10 |
| 3088 | HPV | 16 | 6 | 20 | B*2705 | RRPIVPSVII | 2733 | 1800.00 | 10 |
| 3089 | HPV | 16 | 6 | 21 | B*5102 | EALSSYTL | 2736 | 150.00 | 8 |
| 3090 | HPV | 16 | 6 | 21 | Cw*0301 | MLLLYYAIL | 2739 | 100.00 | 9 |
| 3091 | HPV | 16 | 6 | 21 | A24 | LYYAILEAL | 2740 | 280.00 | 9 |
| 3092 | HPV | 16 | 6 | 21 | Cw*0401 | LYYAILEAL | 2740 | 400.00 | 9 |
| 3093 | HPV | 16 | 6 | 21 | B60 | LEALSSYTL | 2741 | 640.00 | 9 |
| 3094 | HPV | 16 | 6 | 21 | A*0201 | LLYYAILEAL | 2744 | 130.97 | 10 |
| 3095 | HPV | 16 | 6 | 21 | B*2705 | LLYYAILEAL | 2744 | 150.00 | 10 |
| 3096 | HPV | 16 | 6 | 22 | Cw*0301 | VIVFLYCQL | 2869 | 100.00 | 9 |
| 3097 | HPV | 16 | 6 | 22 | A*0201 | FLYCQLYWV | 2870 | 12951.14 | 9 |
| 3098 | HPV | 16 | 6 | 22 | Cw*0301 | VVIVFLYCQL | 2871 | 100.00 | 10 |
| 3099 | HPV | 16 | 6 | 23 | B*2705 | QQYTNRNT | 2872 | 100.00 | 8 |
| 3100 | HPV | 16 | 6 | 23 | B*2705 | NRNTLIYY | 2873 | 1000.00 | 8 |
| 3101 | HPV | 16 | 6 | 23 | B*2705 | QQYTNRNTL | 2874 | 1000.00 | 9 |
| 3102 | HPV | 16 | 6 | 23 | B*2702 | NRNTLIYYF | 2875 | 200.00 | 9 |
| 3103 | HPV | 16 | 6 | 23 | B*2705 | NRNTLIYYF | 2875 | 1000.00 | 9 |
| 3104 | HPV | 16 | 6 | 23 | B*2705 | MQQYTNRNTL | 2876 | 200.00 | 10 |
| 3105 | HPV | 16 | 6 | 23 | B*2705 | QQYTNRNTLI | 2877 | 300.00 | 10 |
| 3106 | HPV | 16 | 6 | 25 | B*2705 | FQSHGALL | 2878 | 200.00 | 8 |

TABLE 7-continued

| No | Species | Strain type | Frame | ORF | HLA | Seq | Seq ID No. | Score | Length |
|---|---|---|---|---|---|---|---|---|---|
| 3107 | HPV | 16 | 6 | 25 | B*2705 | TRCLRFQI | 2879 | 600.00 | 8 |
| 3108 | HPV | 16 | 6 | 25 | B*2705 | LRFQIISF | 2880 | 5000.00 | 8 |
| 3109 | HPV | 16 | 6 | 25 | B*2705 | LQLYFVFL | 2881 | 200.00 | 8 |
| 3110 | HPV | 16 | 6 | 25 | Cw*0401 | VFQSHGALL | 2882 | 264.00 | 9 |
| 3111 | HPV | 16 | 6 | 25 | B*2705 | LQYCHTRCL | 2883 | 300.00 | 9 |
| 3112 | HPV | 16 | 6 | 25 | B*2705 | TRCLRFQII | 2884 | 600.00 | 9 |
| 3113 | HPV | 16 | 6 | 25 | B62 | CLRFQIISF | 2885 | 144.00 | 9 |
| 3114 | HPV | 16 | 6 | 25 | B14 | LRFQIISFL | 2886 | 300.00 | 9 |
| 3115 | HPV | 16 | 6 | 25 | B*2702 | LRFQIISFL | 2886 | 300.00 | 9 |
| 3116 | HPV | 16 | 6 | 25 | B*2705 | LRFQIISFL | 2886 | 10000.00 | 9 |
| 3117 | HPV | 16 | 6 | 25 | B*2705 | FQIISFLQL | 2887 | 200.00 | 9 |
| 3118 | HPV | 16 | 6 | 25 | Cw*0301 | FQIISFLQL | 2887 | 100.00 | 9 |
| 3119 | HPV | 16 | 6 | 25 | Cw*0401 | SFLQLYFVF | 2888 | 100.00 | 9 |
| 3120 | HPV | 16 | 6 | 25 | A*0201 | FLQLYFVFL | 2889 | 1026.89 | 9 |
| 3121 | HPV | 16 | 6 | 25 | B*2705 | LQLYFVFLY | 2890 | 100.00 | 9 |
| 3122 | HPV | 16 | 6 | 25 | B62 | LQLYFVFLY | 2890 | 160.00 | 9 |
| 3123 | HPV | 16 | 6 | 25 | A*0201 | QLYFVFLYI | 2891 | 348.87 | 9 |
| 3124 | HPV | 16 | 6 | 25 | B*5102 | LPVTSAEFPL | 2892 | 330.00 | 10 |
| 3125 | HPV | 16 | 6 | 25 | B*5102 | FPLQYCHTRC | 2893 | 132.00 | 10 |
| 3126 | HPV | 16 | 6 | 25 | B*2705 | LQYCHTRCLR | 2894 | 500.00 | 10 |
| 3127 | HPV | 16 | 6 | 25 | Cw*0401 | QYCHTRCLRF | 2895 | 110.00 | 10 |
| 3128 | HPV | 16 | 6 | 25 | A24 | QYCHTRCLRF | 2895 | 100.00 | 10 |
| 3129 | HPV | 16 | 6 | 25 | B*2705 | TRCLRFQIIS | 2896 | 200.00 | 10 |
| 3130 | HPV | 16 | 6 | 25 | B*2705 | LRFQIISFLQ | 2897 | 100.00 | 10 |
| 3131 | HPV | 16 | 6 | 25 | Cw*0401 | RFQIISFLQL | 2898 | 200.00 | 10 |
| 3132 | HPV | 16 | 6 | 25 | B*2705 | FQIISFLQLY | 2899 | 100.00 | 10 |
| 3133 | HPV | 16 | 6 | 25 | B62 | FQIISFLQLY | 2899 | 160.00 | 10 |
| 3134 | HPV | 16 | 6 | 25 | A*0201 | IISFLQLYFV | 2900 | 205.66 | 10 |
| 3135 | HPV | 16 | 6 | 25 | Cw*0301 | SFLQLYFVFL | 2901 | 100.00 | 10 |
| 3136 | HPV | 16 | 6 | 25 | Cw*0401 | SFLQLYFVFL | 2901 | 200.00 | 10 |
| 3137 | HPV | 16 | 6 | 25 | A3 | FLQLYFVFLY | 2902 | 108.00 | 10 |
| 3138 | HPV | 16 | 6 | 26 | B*2705 | QRMCCLCF | 2745 | 1000.00 | 8 |
| 3139 | HPV | 16 | 6 | 26 | A3 | MLFCFLCSK | 2746 | 450.00 | 9 |
| 3140 | HPV | 16 | 6 | 26 | B*2705 | MLFCFLCSK | 2746 | 150.00 | 9 |
| 3141 | HPV | 16 | 6 | 26 | Cw*0401 | CFLCSKQRM | 2747 | 100.00 | 9 |
| 3142 | HPV | 16 | 6 | 26 | B*2705 | KQRMCCLCF | 2748 | 300.00 | 9 |
| 3143 | HPV | 16 | 6 | 26 | B62 | KQRMCCLCF | 2748 | 288.00 | 9 |
| 3144 | HPV | 16 | 6 | 26 | B*2705 | QRMCCLCFC | 2749 | 200.00 | 9 |
| 3145 | HPV | 16 | 6 | 26 | B*2705 | RMCCLCFCL | 2750 | 150.00 | 9 |
| 3146 | HPV | 16 | 6 | 26 | B*2705 | QRMCCLCFCL | 2754 | 2000.00 | 10 |
| 3147 | HPV | 16 | 6 | 27 | B*2705 | VRFCLSSW | 2903 | 1000.00 | 8 |
| 3148 | HPV | 16 | 6 | 27 | B*2702 | VRFCLSSWT | 2904 | 100.00 | 9 |
| 3149 | HPV | 16 | 6 | 27 | B*2705 | VRFCLSSWT | 2904 | 1000.00 | 9 |
| 3150 | HPV | 16 | 6 | 27 | B*2702 | VRFCLSSWTI | 2905 | 300.00 | 10 |
| 3151 | HPV | 16 | 6 | 27 | B*2705 | VRFCLSSWTI | 2905 | 3000.00 | 10 |
| 3152 | HPV | 16 | 6 | 27 | A*0201 | CLSSWTIYFI | 2906 | 131.97 | 10 |
| 3153 | HPV | 16 | 6 | 28 | B*2705 | HRPVHRPL | 2757 | 2000.00 | 8 |
| 3154 | HPV | 16 | 6 | 28 | B*5102 | RPVHRPLI | 2758 | 1320.00 | 8 |
| 3155 | HPV | 16 | 6 | 28 | B*2705 | HRPLILWN | 2759 | 200.00 | 8 |
| 3156 | HPV | 16 | 6 | 28 | B*5102 | RPLILWNL | 2760 | 300.00 | 8 |
| 3157 | HPV | 16 | 6 | 28 | B*2705 | ILWNLCFL | 2761 | 150.00 | 8 |
| 3158 | HPV | 16 | 6 | 28 | B*2705 | SRCLCFSS | 2762 | 200.00 | 8 |
| 3159 | HPV | 16 | 6 | 28 | B*2702 | CRCISMHDY | 2907 | 200.00 | 9 |
| 3160 | HPV | 16 | 6 | 28 | B*2705 | CRCISMHDY | 2907 | 1000.00 | 9 |
| 3161 | HPV | 16 | 6 | 28 | B*3901 | MHDYSWVSL | 2908 | 270.00 | 9 |
| 3162 | HPV | 16 | 6 | 28 | B14 | HRPVHRPLI | 2763 | 120.00 | 9 |
| 3163 | HPV | 16 | 6 | 28 | B*2705 | HRPVHRPLI | 2763 | 600.00 | 9 |
| 3164 | HPV | 16 | 6 | 28 | B*5102 | RPVHRPLIL | 2764 | 330.00 | 9 |
| 3165 | HPV | 16 | 6 | 28 | B14 | HRPLILWNL | 2765 | 120.00 | 9 |
| 3166 | HPV | 16 | 6 | 28 | B*2705 | HRPLILWNL | 2765 | 2000.00 | 9 |
| 3167 | HPV | 16 | 6 | 28 | A*0201 | LILWNLCFL | 2766 | 233.72 | 9 |
| 3168 | HPV | 16 | 6 | 28 | Cw*0401 | CFLSRCLCF | 2767 | 110.00 | 9 |
| 3169 | HPV | 16 | 6 | 28 | Cw*0401 | CFSSGHSGF | 2768 | 100.00 | 9 |
| 3170 | HPV | 16 | 6 | 28 | B*2705 | CRCISMHDYS | 2909 | 200.00 | 10 |
| 3171 | HPV | 16 | 6 | 28 | A*0201 | SMHDYSWVSL | 2910 | 107.54 | 10 |
| 3172 | HPV | 16 | 6 | 28 | Cw*0401 | DYSWVSLRVL | 2911 | 400.00 | 10 |
| 3173 | HPV | 16 | 6 | 28 | A24 | DYSWVSLRVL | 2911 | 200.00 | 10 |
| 3174 | HPV | 16 | 6 | 28 | B*2705 | QQDIHRPVHR | 2769 | 100.00 | 10 |
| 3175 | HPV | 16 | 6 | 28 | B14 | HRPVHRPLIL | 2770 | 400.00 | 10 |
| 3176 | HPV | 16 | 6 | 28 | B*2705 | HRPVHRPLIL | 2770 | 2000.00 | 10 |
| 3177 | HPV | 16 | 6 | 28 | B*2705 | HRPLILWNLC | 2771 | 200.00 | 10 |
| 3178 | HPV | 16 | 6 | 28 | A3 | ILWNLCFLSR | 2772 | 120.00 | 10 |
| 3179 | HPV | 16 | 6 | 28 | B*2705 | SRCLCFSSGH | 2773 | 200.00 | 10 |
| 3180 | HPV | 16 | 6 | 29 | B*2705 | SRKAKSYT | 2912 | 200.00 | 8 |
| 3181 | HPV | 16 | 6 | 29 | B*2705 | SRRSNCCL | 2913 | 2000.00 | 8 |
| 3182 | HPV | 16 | 6 | 29 | B*2705 | LQYTHSNI | 2914 | 300.00 | 8 |

TABLE 7-continued

| No | Species | Strain type | Frame | ORF | HLA | Seq | Seq ID No. | Score | Length |
|---|---|---|---|---|---|---|---|---|---|
| 3183 | HPV | 16 | 6 | 29 | B*2705 | SRKAKSYTS | 2915 | 200.00 | 9 |
| 3184 | HPV | 16 | 6 | 29 | B*2702 | RRSNCCLQY | 2916 | 600.00 | 9 |
| 3185 | HPV | 16 | 6 | 29 | B*2705 | RRSNCCLQY | 2916 | 3000.00 | 9 |
| 3186 | HPV | 16 | 6 | 29 | B*2705 | LQYTHSNII | 2917 | 300.00 | 9 |
| 3187 | HPV | 16 | 6 | 29 | B*5201 | LQYTHSNII | 2917 | 825.00 | 9 |
| 3188 | HPV | 16 | 6 | 29 | B*2705 | SRKAKSYTSR | 2918 | 1000.00 | 10 |
| 3189 | HPV | 16 | 6 | 29 | B*2702 | SRRSNCCLQY | 2919 | 200.00 | 10 |
| 3190 | HPV | 16 | 6 | 29 | B*2705 | SRRSNCCLQY | 2919 | 1000.00 | 10 |
| 3191 | HPV | 16 | 6 | 29 | B*2705 | RRSNCCLQYT | 2920 | 600.00 | 10 |
| 3192 | HPV | 16 | 6 | 29 | B*2705 | LQYTHSNIIS | 2921 | 100.00 | 10 |

4. Influenza

Vaccination of mice with ncORF derived peptides from influenza A virus in combination with KLK/o-d(IC)$_{13}$. Specific T-cell response is measured 7 days after vaccination, and animals are subsequently challenged with a lethal dose of mouse adapted influenza A virus (x31). Survival is monitored for 15 days.

Materials

Mice C57B1/6 (Harlan-Winkelmann, Germany)

Peptides p82 (GLCTLVAML—SEQ ID NO: 1038)
  Control peptide derived from EBV; HLA-A*0201; AA start 280
  p1574 (IASNENMETM—SEQ ID NO: 1039) Control peptide derived from Influenza nucleoprotein, AA start 365
  p1569 (TMLYNKMEF—SEQ ID NO: 1040) Flu ncORF derived peptide from segment 1, frame 1, ORF 1, AA start 569
  p1600 (SSIAAQDAL—SEQ ID NO: 1041) Flu ncORF derived peptide from segment 3, frame 6, ORF 2, AA start 83
  P1664 (VTILNLALL—SEQ ID NO: 1042) Flu ncORF derived peptide from segment 4, frame 5, ORF 6, AA start 9
  Dose: 100 µg/peptide/mouse o-d(IC)$_{13}$ ODN 5'ICI CIC ICI CIC ICI CIC ICI CIC—SEQ ID NO: 1043
(=ODN1a) IC3'
  was synthesized by Purimex Nucleic Acids Technology, Göttingen
  Dose: 5 nmol/mouse KLK KLKLLLLLKLK—COOH—SEQ ID NO: 1044
  was synthesized by MPS (Multiple Peptide System, USA)
  Dose: 127 nmol/mouse Formulation 270 mM Sorbit/10 mM Hepes Influenza A x31, mouse adapted influenza A virus, virus rec. virus derived from A/Pr/8/34 (seg 1, 2, 3, 5, 7, 8) and A/Aichi/2/68 (seg 4, 6)

Experimental Setup (15 Mice/Group)
1. p1574+KLK+o-d(IC)$_{13}$
2. p1569+KLK+o-d(IC)$_{13}$
3. p1600+KLK+o-d(IC)$_{13}$
4. p1664+KLK+o-d(IC)$_{13}$
5. p1600+p1569+KLK+o-d(IC)$_{13}$ On day 0 mice were injected s.c. into both hind footpads with a total amount of 100 µl vaccine/mouse (50 µl/foot) containing the above listed compounds. On day 7, unseparated splenocytes from 5 mice were stimulated in 96-well ELIspot plates in order to enumerate the number of peptide-specific IFN-γ producing cells for each experimental group.

Remaining 10 mice were challenged with mouse adapted x31 influenza A virus (5* 10E5 pfu). Survival was monitored for 15 days.

Results ELIspot (FIG. 5a)

Spleen cells of groups 1 and 3 (peptides p1574 and p1600) do not show any specific spots after restimulation with the respective peptides. Groups 2 and 4 (p1569 and p1664) specifically release IFN-γ after restimulation. Group 5 was vaccinated with two individual peptides (not as a mix, p1600 and p1569). Upon restimulation with either the mix of both peptides or p1569, specific cytokine release is detected. In contrast, upon restimulation with p1600 alone, no IFN-γ spots are detectable. This is consistent with group 3 (p1600 alone).

Results Challenge (FIG. 5b)

FIG. 5b shows the survival rate of challenged mice with a lethal dose of mice adapted influenza A virus x31. Group 1 (p1574, reported protective epitope for H2-Db) protects 30% of all challenged mice. Peptide p1569 does not at all provide protection (0%). In contrast, peptides p1600 and p1664 do protect 50% and 62% of challenged animals, respectively. When animals are vaccinated with two different peptides (group 5, peptides p1600 and 1569) up to 70% of animals are protected.

SEQUENCE LISTING (8621 sequences)

SEQ ID NO: 1 - protein, 28 aa, Hepatitis C virus
MGATLHHESLPCEELLSSRRKRLAMALV

SEQ ID NO: 2 - protein, 76 aa, Hepatitis C virus
MAMRAAGGRDGSCLPVALGLAGAPQTPGVGRAIWVRSSIPLRAASPTSWGTYRSSAPLLEALPGPWRMASGFWKTA

SEQ ID NO: 3 - protein, 21 aa, Hepatitis C virus
MQQGTFLVALSLSSFWPCSLA

SEQ ID NO: 4 - protein, 37 aa, Hepatitis C virus
MIALTRVLCTRRPMPSCTLRGASLAFARATPRGVGWR

SEQ ID NO: 5 - protein, 63 aa, Hepatitis C virus
MANSPRRSFDVTSICLSGAPPSVRPSTWGTCAGLSFLSANCLPSLPGATGRRKVAIALSIPAI

SEQ ID NO: 6 - protein, 26 aa, Hepatitis C virus
MIASTPAGWQGFSITTSSTLQAVLRG

SEQ ID NO: 7 - protein, 81 aa, Hepatitis C virus
MPTEAAPTSAPTAGTTPQNLAVLCPRRVCVVRYIASLPAPWWWERPTGRARPPTAGVKMIRTSSSLTIPGHRWAIGSVVPG

SEQ ID NO: 8 - protein, 23 aa, Hepatitis C virus
MQHPWPGRTVLYPSSCSSALHGI

SEQ ID NO: 9 - protein, 23 aa, Hepatitis C virus
MFITISLLFGTGRTTACEIWPWL

SEQ ID NO: 10 - protein, 24 aa, Hepatitis C virus
MEWSPRVGGCWRPSRRTPSRQGAS

SEQ ID NO: 11 - protein, 29 aa, Hepatitis C virus
MGCAGLSTTGPERGPSRHPRVLSSRCIPM

SEQ ID NO: 12 - protein, 23 aa, Hepatitis C virus
MSFPCAGGVIAGAACCRPGPFPT

SEQ ID NO: 13 - protein, 23 aa, Hepatitis C virus
MLPQAAAKAPRSRLHMQLRAIRC

SEQ ID NO: 14 - protein, 10 aa, Hepatitis C virus
MGSILTSGPG

SEQ ID NO: 15 - protein, 62 aa, Hepatitis C virus
MPHPSWASALSLTKQRLRGRDWLCSPPPPLRAPSLCPIPTSRRLLCPPPERSLFTARLSPSK

SEQ ID NO: 16 - protein, 28 aa, Hepatitis C virus
MPWPTTAVLTCPSSRPAAMLSSWQPMPS

SEQ ID NO: 17 - protein, 63 aa, Hepatitis C virus
MLSPALNVGAGLAGGSQASTDLWHRGSAPPACSTRPSSVSAMTQAVLGMSSRPPRLQLGYERT

SEQ ID NO: 18 - protein, 18 aa, Hepatitis C virus
MPTFYPRQSRVGRTFLTW

SEQ ID NO: 19 - protein, 18 aa, Hepatitis C virus
MGQHPCYTDWALFRMKSP

SEQ ID NO: 20 - protein, 16 aa, Hepatitis C virus
MRWKSALSTYRTSSKG

SEQ ID NO: 21 - protein, 14 aa, Hepatitis C virus
MARAWRELLWHSRS

SEQ ID NO: 22 - protein, 30 aa, Hepatitis C virus
MPTPRAPVPPFLRRTTRSRYGGCLQRNTWR

SEQ ID NO: 23 - protein, 30 aa, Hepatitis C virus; identical to SEQ ID NO: 22

SEQ ID NO: 24 - protein, 8 aa, Hepatitis C virus
MTPLMLSS

SEQ ID NO: 25 - protein, 134 aa, Hepatitis C virus
MAARFHLQSPLLCLRLGRSGRWSSLNQPYLLPWPSSPPEALAAPQLPALRATIRQHPLSPPLLAAPPTPTLSPIPPCPPWRGSLGIRILATGHGQRSVVRPTRRMSCAAQCLTLGQAHSSPRAPRKNRNCPSMH

SEQ ID NO: 26 - protein, 13 aa, Hepatitis C virus
MGQKTSVAMPERP

SEQ ID NO: 27 - protein, 66 aa, Hepatitis C virus
MIPAALTPQSLRATSVRRRQSTNVVTSTPKPAWPSSPSPRGFMLGALLPIQGGRTAAIAGAARAAY

SEQ ID NO: 28 - protein, 63 aa, Hepatitis C virus
MASAHFHSTVTLQVKSIGWPHASENLGYRPCELGDTGPGASALGFWPEEAGLPYVASTSSTGQ

SEQ ID NO: 29 - protein, 17 aa, Hepatitis C virus
MPGPAGSGFAYSCLLQG

SEQ ID NO: 30 - protein, 16 aa, Hepatitis C virus
MNHSPVRNYCLHAESV

SEQ ID NO: 31 - protein, 12 aa, Hepatitis C virus
MPGDLGVPPQDC

SEQ ID NO: 32 - protein, 10 aa, Hepatitis C virus
MAPVSPWLSA

SEQ ID NO: 33 - protein, 81 aa, Hepatitis C virus
MGYDDELVPYDGVGNGSAAPDPTSHLGHDRWCSLGSPGGHSVFLHGGELGEGPGSAAAICRRRRGNPRHRGKCRPHCVWIC

SEQ ID NO: 34 - protein, 49 aa, Hepatitis C virus
MHVGRPGGRHEHLGARWRRPGCFGRVLPVNRLRGHSGQGRLVREAGNHT

SEQ ID NO: 35 - protein, 20 aa, Hepatitis C virus
MLRFLAKGHLGLDMRGVERL

SEQ ID NO: 36 - protein, 25 aa, Hepatitis C virus
MEGVCRGIRGDKAGGGLPLRDGYDY

SEQ ID NO: 37 - protein, 20 aa, Hepatitis C virus
MPVPGPIARIFHRIGRGAPT

SEQ ID NO: 38 - protein, 12 aa, Hepatitis C virus
MEAGDGRQHHQG

SEQ ID NO: 39 - protein, 21 aa, Hepatitis C virus
MLLQRVSRPRRRWKEGLLPHP

SEQ ID NO: 40 - protein, 22 aa, Hepatitis C virus
MPQKTWGTALASLETPGPERPR

SEQ ID NO: 41 - protein, 81 aa, Hepatitis C virus
MWQVPLQLGSKNKAQTHSNSGRWPAGLVRLVHGWLQRGRHLSQRVSCPAPLDLVLPTPACCRGRHLPPPQPVKVGVNTPAS

SEQ ID NO: 42 - protein, 15 aa, Hepatitis C virus
MSVVQPPGPPLPGEP

SEQ ID NO: 43 - protein, 24 aa, Hepatitis C virus
MIPPPAARACRGAQTYVGAPRPIL

SEQ ID NO: 44 - protein, 20 aa, Hepatitis C virus
MEWYTPSLSTGAVASGAGLQ

SEQ ID NO: 45 - protein, 17 aa, Hepatitis C virus
MPQELPPRPRHTLQGCL

SEQ ID NO: 46 - protein, 20 aa, Hepatitis C virus
MKQWRGYQAALTSPPSIVSH

SEQ ID NO: 47 - protein, 18 aa, Hepatitis C virus
MRPALRRVRRTSSLNDRR

SEQ ID NO: 48 - protein, 33 aa, Hepatitis C virus
MWHPWSGTRHKLLCHKRPPSTRRRQGTCRRWST

SEQ ID NO: 49 - protein, 33 aa, Hepatitis C virus
MQPGPWCFCRCLWEHGGEPPGSSGALLVERSYP

SEQ ID NO: 50 - protein, 22 aa, Hepatitis C virus
MSGYLAERASPQGLDLHWYTSG

SEQ ID NO: 51 - protein, 79 aa, Hepatitis C virus
MVTELAPSTRREQHRHTTRPPPCPARTPAGATPTGAGGEATSRRRCRPLRAPTYPSDTMQSRRTRGRIQDRASRPGMLH

SEQ ID NO: 52 - protein, 23 aa, Hepatitis C virus
MWRPDACGSNQWGSAGCCCPPLR

SEQ ID NO: 53 - protein, 12 aa, Hepatitis C virus
MPCGDPLYGRDR

SEQ ID NO: 54 - protein, 16 aa, Hepatitis C virus
MALPGGGVLEAARHSY

SEQ ID NO: 55 - protein, 82 aa, Hepatitis C virus
MRLTDLSQLAVTRAKMEPPLKKEGKERKKEGKKKKKKKKEKKKKKEKKKKKKKKKKKKKKKKTGNGLRGRSVYPNLHRLGRR

SEQ ID NO: 56 - protein, 19 aa, Hepatitis C virus
MPTPAASRSRQNQIQRGRA

SEQ ID NO: 57 - protein, 43 aa, Hepatitis C virus
MAALPPLARSLARTLRARCLQARKGGTPSFLRHAATLLISPGE

SEQ ID NO: 58 - protein, 11 aa, Hepatitis C virus
MIGGRSSGSME

SEQ ID NO: 59 - protein, 31 aa, Hepatitis C virus
MIMLPSQELTGVCLAVSHAALARGVVGSRVR

SEQ ID NO: 60 - protein, 67 aa, Hepatitis C virus
MSSKSYSGCGGSPGGAEYLVIASVKALRLAASSWTPALSQITTKSSPHTSMVQSWSPAARQAARALM

SEQ ID NO: 61 - protein, 13 aa, Hepatitis C virus
MATRAWGSRSQHW

SEQ ID NO: 62 - protein, 42 aa, Hepatitis C virus
MSLSVTVESKQRVSYENPIGVFLDFHACTRNSTRCPGEYWNP

SEQ ID NO: 63 - protein, 12 aa, Hepatitis C virus
MRRAGLRPPFSG

SEQ ID NO: 64 - protein, 36 aa, Hepatitis C virus
MMVVSIGVTLSSRRSFHTELMWVTAFLAWQRTSFAP

SEQ ID NO: 65 - protein, 19 aa, Hepatitis C virus
MGSFCSSAAHGVTSAPVQE

SEQ ID NO: 66 - protein, 54 aa, Hepatitis C virus
MPEVEELPKLLVASSAKAVDRVDSVRTTVRFFRGGGTGGDFGGGSGQPWTTGGS

SEQ ID NO: 67 - protein, 140 aa, Hepatitis C virus
MLPPISCLHRRLASMSSASGESWLAVQVALRDGADSWLAEELATEGGDPLANLRPAASAVIWEGSVSMDVNTATSGSGSQGNCDPTGYSWSPTLNDTSSRSKGLQGGANLCRRTPSNSVKNSGDGTWHGHLRLSVVIPVT

SEQ ID NO: 68 - protein, 128 aa, Hepatitis C virus
MGKVPLHMFLQVLGPTILIVPFLTCPVISAPQWQRVCMMPSPRQTPLYPRWQDTKGIPGSCGMSLAFSQVLKSLNTSHIQSQMSLSQEPEHGVVHSELIHWCSRLRSWVTVRLLSMAVTRAAASLSGT

SEQ ID NO: 69 - protein, 144 aa, Hepatitis C virus
MAGSRLTRSSVEGTSPLMILNATRAPATPAPYPARMSMRTFPSPTLPMAAPAKPAPTKAVAAPGAASWAATHPPNMLKRRVWLVVSGLVTAAVKAINEAMAGLPGSVDKPAKYCIPLMKFHICFAQKVSSFCQLVWTAGAITSA

SEQ ID NO: 70 - protein, 63 aa, Hepatitis C virus
MIAGFPDKTTLPTMTTQPVDRQYAAKAARTPPTSTQVLVTTSRSADMHVMMYLVTGCVRVISF

SEQ ID NO: 71 - protein, 22 aa, Hepatitis C virus
MYARSLTVVSAGVSSYQAQPAS

SEQ ID NO: 72 - protein, 12 aa, Hepatitis C virus
MPEGRSPGATNL

SEQ ID NO: 73 - protein, 12 aa, Hepatitis C virus
MPGFPLPVLPRR

SEQ ID NO: 74 - protein, 28 aa, Hepatitis C virus
MVKVGSRLKSTVWVTHVLQSITESKSPV

SEQ ID NO: 75 - protein, 23 aa, Hepatitis C virus
MRASVATTTTSPLVGMTDTSRPR

SEQ ID NO: 76 - protein, 17 aa, Hepatitis C virus
MPNATSFAASSSHFFFE

SEQ ID NO: 77 - protein, 16 aa, Hepatitis C virus
MRCLPPLITSRGIALP

SEQ ID NO: 78 - protein, 52 aa, Hepatitis C virus
MLGWGTVTEPGGVAVASTTSLAPAVSAWSRTVPMPKMDVASVEWHSSQIIMS

SEQ ID NO: 79 - protein, 19 aa, Hepatitis C virus
MGLPVVIVLTPVLMLGSIP

SEQ ID NO: 80 - protein, 45 aa, Hepatitis C virus
MVVSRFSTGIKSTALATPRVHTAALNMPTACPAGHNSGPPEEPFK

SEQ ID NO: 81 - protein, 27 aa, Hepatitis C virus
MGRGDSRLPLLSPRRRTGMTSACLVTR

SEQ ID NO: 82 - protein, 16 aa, Hepatitis C virus
MTGPLGDAMVLVPAPW

SEQ ID NO: 83 - protein, 124 aa, Hepatitis C virus
MHVARKVWAAVDTIWTSPSTWFLSRPVRLVIMHPRRPLVCWAYAVMGASNLQPLETIPSAGPSSISRPLRAETGKPLMMSPHAAVSAPHVMSLVSIWEKTTGSTATARSRKPLCAQSRRGVRWL

SEQ ID NO: 84 - protein, 41 aa, Hepatitis C virus
MSNTRVGCTAHMSKMTASRPPRTLRGGIHTCSCASTLVRKY

SEQ ID NO: 85 - protein, 117 aa, Hepatitis C virus
MSSIIHKQEQTRASASRRNRRTTYSHLMAQDAMLDPTPYKYCTSTMFWWRWMRPVDKAGRVVKEHGRTCHCVVVSSNGLSSDLSLSSRSQRSPRVQLQAASSLCSTPPTYILILNIV

SEQ ID NO: 86 - protein, 44 aa, Hepatitis C virus
MTQGGAPHTLVNPVEFIQVQPNQLPSGGLVLLRTKTSVSFSPQL

SEQ ID NO: 87 - protein, 12 aa, Hepatitis C virus
MEKYAMPARTPQ

SEQ ID NO: 88 - protein, 11 aa, Hepatitis C virus
MSKMACGIRSS

SEQ ID NO: 89 - protein, 19 aa, Hepatitis C virus
MASAASYTILELGQSLVTW

SEQ ID NO: 90 - protein, 51 aa, Hepatitis C virus
MYPMRSAKPHVRVSMTLPKLRDLRRGSVGPQLGREPRGDRSHPAHPQPSLP

SEQ ID NO: 91 - protein, 43 aa, Hepatitis C virus
MVHGLRDLPGHSQAPYQAVPQGLSRPNTTRLAVLRGHAQISRH

SEQ ID NO: 92 - protein, 25 aa, Hepatitis C virus
MICREASISTLCSHAAHGPFTASRD

SEQ ID NO: 93 - protein, 93 aa, Hepatitis C virus
MRHAVINVSPAVASREPAGQVQLASGRYWSEFELCSYCPVEEVLATYGSPASSGQKPSADAPGPVSPSSQGRYPKFSEACGHPIDFTWRVTVE

SEQ ID NO: 94 - protein, 8 aa, Hepatitis C virus
MESLNDWR

SEQ ID NO: 95 - protein, 19 aa, Hepatitis C virus
MGHQYHPRPQCGGKHDYVA

SEQ ID NO: 96 - protein, 15 aa, Hepatitis C virus
MATDVFCPITKLGFG

SEQ ID NO: 97 - protein, 21 aa, Hepatitis C virus
MAVQNLQSVKCDFLLPLASTA

SEQ ID NO: 98 - protein, 15 aa, Hepatitis C virus
MDHRWFVVGLFPRLH

SEQ ID NO: 99 - protein, 13 aa, Hepatitis C virus
MVSGASCLERWSG

SEQ ID NO: 100 - protein, 20 aa, Hepatitis C virus
MGGISEHGRQHGHVRFGLAR

SEQ ID NO: 101 - protein, 43 aa, Hepatitis C virus
MSSDLSSTVAASVHDAVPSPDPLIPALAGHKGDPRQLWHELSF

SEQ ID NO: 102 - protein, 46 aa, Hepatitis C virus
MVPPGGEGYQPVHPLHCPLARANVPAQYCCTDHADYEGSGREDGGQ

SEQ ID NO: 103 - protein, 49 aa, Hepatitis C virus
MLRPEGLEFLPVGLDSRGDNLCLTGRGLQEAEGLLLELLGEHHPLLDVR

SEQ ID NO: 104 - protein, 46 aa, Hepatitis C virus
MEGGLEANQTLPHLVPRWGRGLSPSAHGGLVRYQVRKVLPTLLCLG

SEQ ID NO: 105 - protein, 28 aa, Hepatitis C virus
MSEACEDALPKFKVVLAHGKPRGVHVRS

SEQ ID NO: 106 - protein, 143 aa, Hepatitis C virus
MTEDEMSPPLDYFEGDSLAVKRDLSGGGQSNLLDVGMGHSDGARRGGGGEHNQSRPRSLCLVKDSADAQDGCGIRGVALVTNYYVISAPRAPAVGKELAVGGVRDGAASGNCSHPGPDVRIDPMSLGHVSTKAQCCSNRGVEY

SEQ ID NO: 107 - protein, 28 aa, Hepatitis C virus
MEVSHLEALGHYWWRGVIREHRGPHGCL

SEQ ID NO: 108 - protein, 11 aa, Hepatitis C virus
MVINIGASKRP

SEQ ID NO: 109 - protein, 8 aa, Hepatitis C virus
MASDHLPR

SEQ ID NO: 110 - protein, 60 aa, Hepatitis C virus
MPKPIRVVDQAPGCDPGTGAAPRVCGVRMLAEAISGAVQGVVARPSDDTRRRSAHFGESS

SEQ ID NO: 111 - protein, 58 aa, Hepatitis C virus
MATRVWGGQDGSCHPVALGLVGAPQTPGVGRVIWVRSSIPLHAASPTSWGTFRLSAPP

SEQ ID NO: 112 - protein, 9 aa, Hepatitis C virus
MASGFWRTA

SEQ ID NO: 113 - protein, 15 aa, Hepatitis C virus
MQQGICPVALSLSSS

SEQ ID NO: 114 - protein, 17 aa, Hepatitis C virus
MSRTTAPTQVLCMRQRT

SEQ ID NO: 115 - protein, 24 aa, Hepatitis C virus
MRRYKIAIAQSIPATYQVTAWLGI

SEQ ID NO: 116 - protein, 125 aa, Hepatitis C virus
MTPSKLGSLLRCSTHTGSTRPDVQSAWPAAAPSTSSLRGGVPSLTLCLTSRTRGLIAGTMHPNRAVLYPRRRCVAQCIASPRVLLWWGRPTVPESPRIAGGRMRQTCCYSTTRGRRKATGSAVHG

SEQ ID NO: 117 - protein, 19 aa, Hepatitis C virus
MFCCSSFSWRTRASVPACG

SEQ ID NO: 118 - protein, 69 aa, Hepatitis C virus
MRRLWPERMAFSPSSCSSAPPGTSKAGWSLGRHMLSMAYGRCSCSCWLYHHELMPWTERWLHRAEARFL

SEQ ID NO: 119 - protein, 19 aa, Hepatitis C virus
MFGEAAMPSSSLHARSIQS

SEQ ID NO: 120 - protein, 17 aa, Hepatitis C virus
MWTRTSSAGRRPPGRVP

SEQ ID NO: 121 - protein, 25 aa, Hepatitis C virus
MLTSFRCAGGATVGGACSPPGLSPT

SEQ ID NO: 122 - protein, 18 aa, Hepatitis C virus
MQPKGTRCSSSIRPLPLP

SEQ ID NO: 123 - protein, 17 aa, Hepatitis C virus
MASFLPMVVALGALMTS

SEQ ID NO: 124 - protein, 124 aa, Hepatitis C virus
MSAIQLTRLQSWASAQSWTKRRRLERGLSCSPPLRLRDRSPCHTQTSRRWPCLILERSPSMAKPSPLKPSGGEGISFSVIPRRSATSSPQSCQASESTLWRITGGSMCPSYQLSETSLSWQQTL

SEQ ID NO: 125 - protein, 22 aa, Hepatitis C virus
MTRAVLGTSSPPPRPRLGCGPT

SEQ ID NO: 126 - protein, 18 aa, Hepatitis C virus
MHTSCPRPSRQETTSPTW

SEQ ID NO: 127 - protein, 8 aa, Hepatitis C virus
MRSPSPTP

SEQ ID NO: 128 - protein, 69 aa, Hepatitis C virus
MKWKSAPRTSLTLSRECSSPSSSSRKRSGYCKQPPNKRRLLLPWWSPSGEPLRHSGRSTCGISSAGYST

SEQ ID NO: 129 - protein, 14 aa, Hepatitis C virus
MEQEWPARSWPLRS

SEQ ID NO: 130 - protein, 23 aa, Hepatitis C virus
MCLRATPQRVLLRSSPALPSLSC

SEQ ID NO: 131 - protein, 12 aa, Hepatitis C virus
MRTAPHRVPARG

SEQ ID NO: 132 - protein, 9 aa, Hepatitis C virus
MFGTGYARC

SEQ ID NO: 133 - protein, 45 aa, Hepatitis C virus
MEHSPSTHTPRAPAHPLQRQTILGRCGGWPLRSTWRSRGWGISTT

SEQ ID NO: 134 - protein, 32 aa, Hepatitis C virus
MSLRTLTSSRPTSCGGRRWAGTSPAWSRRTRW

SEQ ID NO: 135 - protein, 34 aa, Hepatitis C virus
MRGKYPFRRRSCGNPRSSPQRCPSGRARITTLHC

SEQ ID NO: 136 - protein, 14 aa, Hepatitis C virus
MSSAAQCPTHGQAP

SEQ ID NO: 137 - protein, 33 aa, Hepatitis C virus
MPQHLAAQACGRRRSPLTDCKSWTTTTGTCSRR

SEQ ID NO: 138 - protein, 28 aa, Hepatitis C virus
MGQRTSGTYPARPLTTSTPCGRTCWKTL

SEQ ID NO: 139 - protein, 44 aa, Hepatitis C virus
MRFSVSNQRKEAVSQPALSYSQIWESVYARRWPSMMWSPPFLRS

SEQ ID NO: 140 - protein, 34 aa, Hepatitis C virus
MTLAVSTQRSPRTTSVLRSQFTNVVTWPPKPDRP

SEQ ID NO: 141 - protein, 40 aa, Hepatitis C virus
MCRSPTMHQAKGCTTSPVIPPPPSHGLRGKQLDTLQLTPG

SEQ ID NO: 142 - protein, 8 aa, Hepatitis C virus
MRPLCGQG

SEQ ID NO: 143 - protein, 63 aa, Hepatitis C virus
MALAHFHSIVTLQVRSIGWLHASGNLGYHPCESGDIGPGASALGYCPRGGGPPLVASTSSTGQ

SEQ ID NO: 144 - protein, 12 aa, Hepatitis C virus
MPGDLGVPPRDC

SEQ ID NO: 145 - protein, 10 aa, Hepatitis C virus
MAPVTPWLSA

SEQ ID NO: 146 - protein, 87 aa, Hepatitis C virus
MRLRRPHGVHSACRRPPRRRCQGPGAWRPGSGGRRELCNRESARLLFLYLPLSFAVLFDHPSFRLRGAQRVRDIPCHERLLQLKYCV

SEQ ID NO: 147 - protein, 26 aa, Hepatitis C virus
MSRAHGQLPPHRQVRSGVGSHHSRCA

SEQ ID NO: 148 - protein, 9 aa, Hepatitis C virus
MRLGSLVDT

SEQ ID NO: 149 - protein, 29 aa, Hepatitis C virus
MGVCSAALPSPGGRARLCLLVDDAADSPG

SEQ ID NO: 150 - protein, 42 aa, Hepatitis C virus
MAVAPALAGFTTTSLCHGPRDGCIVRRRGFCRSGTLDLVTIL

SEQ ID NO: 151 - protein, 21 aa, Hepatitis C virus
MVVTIFYHQGRGALASVGPPS

SEQ ID NO: 152 - protein, 9 aa, Hepatitis C virus
MRGPSRANL

SEQ ID NO: 153 - protein, 95 aa, Hepatitis C virus
MHVSAEGRWGSLCPNGLHEAGRADRHVHLQPSYPATGLGPRGPTRPCGGSGARRLLRHGDQDHHLGSRHRGVWGHHLGSARLRPKGKGDTPGPGR

SEQ ID NO: 154 - protein, 15 aa, Hepatitis C virus
MHLWQLRPLLGHETC

SEQ ID NO: 155 - protein, 54 aa, Hepatitis C virus
MHPGGCEGGGLCARRVHGNYYAVSGLHGQLIPPGRTAVISSGPPTRSHWQRQEY

SEQ ID NO: 156 - protein, 16 aa, Hepatitis C virus
MCHPDSRLQLGSHLHH

SEQ ID NO: 157 - protein, 30 aa, Hepatitis C virus
MGSNVEVSHTAETYAARANTLAVQAGSRPK

SEQ ID NO: 158 - protein, 19 aa, Hepatitis C virus
MWSTDHRTCQKRFHEDRRA

SEQ ID NO: 159 - protein, 25 aa, Hepatitis C virus
MRARTGCSSAHFHAHRPLPHHSRNG

SEQ ID NO: 160 - protein, 10 aa, Hepatitis C virus
MHYPPCLSGR

SEQ ID NO: 161 - protein, 29 aa, Hepatitis C virus
MDRRLDHAMRCGGKQAAHQRVEQLFAAPP

SEQ ID NO: 162 - protein, 30 aa, Hepatitis C virus
MLLEGLCSLSSCEAPGLHDARERRRPCRYL

SEQ ID NO: 163 - protein, 21 aa, Hepatitis C virus
MFLQCVGRPRCIRQKGVLPHP

SEQ ID NO: 164 - protein, 22 aa, Hepatitis C virus
MPQETWGTTLASLETSGQERPR

SEQ ID NO: 165 - protein, 10 aa, Hepatitis C virus
MNGELNTPGQ

SEQ ID NO: 166 - protein, 15 aa, Hepatitis C virus
MSVVQPPGPPLPGEP

SEQ ID NO: 167 - protein, 25 aa, Hepatitis C virus
MICREASISTLCSHAAHGPFTASRD

SEQ ID NO: 168 - protein, 31 aa, Hepatitis C virus
MAYWPGVFSSPFIGWGAGRCLPLQKVGVGTA

SEQ ID NO: 169 - protein, 32 aa, Hepatitis C virus
MHRGRPTHWRNMMLSAPSRILVGAGPRGGQST

SEQ ID NO: 170 - protein, 59 aa, Hepatitis C virus
MKSPWGFSLISRYSPGTRLAAQESTGIRMRSPSRPEEGWRPHHRGPSSRIHGLPDLGIR

SEQ ID NO: 171 - protein, 18 aa, Hepatitis C virus
MLWHKPCYGGAAKSCSTR

SEQ ID NO: 172 - protein, 12 aa, Hepatitis C virus
MCRTLSSRRHPH

SEQ ID NO: 173 - protein, 8 aa, Hepatitis C virus
MIRSCRRS

SEQ ID NO: 174 - protein, 11 aa, Hepatitis C virus
MSPSRKAQTTG

SEQ ID NO: 175 - protein, 10 aa, Hepatitis C virus
MVAVTQPGIG

SEQ ID NO: 176 - protein, 20 aa, Hepatitis C virus
MGTLRCQWSCPSRSGNPPPA

SEQ ID NO: 177 - protein, 10 aa, Hepatitis C virus
MFHATCCCRS

SEQ ID NO: 178 - protein, 23 aa, Hepatitis C virus
MPSMMLLRGSQAEWISLLSTVSR

SEQ ID NO: 179 - protein, 31 aa, Hepatitis C virus
MSQGLATWTPPREQQPPLVWWLFAVTRALSA

SEQ ID NO: 180 - protein, 38 aa, Hepatitis C virus
MMEVGPEPWRTPWLGMLPGRGSCLLPAWSGTRSVHLCG

SEQ ID NO: 181 - protein, 28 aa, Hepatitis C virus
MCYSRSLSQSRPYSPSSERLLPRQRRLR

SEQ ID NO: 182 - protein, 12 aa, Hepatitis C virus
MTAVRPGGMSCP

SEQ ID NO: 183 - protein, 20 aa, Hepatitis C virus
MVSRNAPRGAPASRRGPGPH

SEQ ID NO: 184 - protein, 55 aa, Hepatitis C virus
MVTRSRVPDLQKPRLRTMQPSLGPWHKLVVVKPARAGATAIRHREHMPPQGPACL

SEQ ID NO: 185 - protein, 14 aa, Hepatitis C virus
MYSRTSCLAAAACC

SEQ ID NO: 186 - protein, 38 aa, Hepatitis C virus
MALVRARTRGSGCWRLPFPLSRGCARQRQQRVASQSRP

SEQ ID NO: 187 - protein, 16 aa, Hepatitis C virus
MALPGGGVLEAARHSY

SEQ ID NO: 188 - protein, 23 aa, Hepatitis C virus
MPTPTESRSRHSMNQRGRARDRL

SEQ ID NO: 189 - protein, 31 aa, Hepatitis C virus
MIMLPSQELTGVCLAVSHAARARGVVGSRVR

SEQ ID NO: 190 - protein, 13 aa, Hepatitis C virus
MACLASGAKSQHW

SEQ ID NO: 191 - protein, 49 aa, Hepatitis C virus
MSFSVTVESKQRVSYEKPMGFFFDFQVFTRNSTRCPGEYWNPYEEPITT

SEQ ID NO: 192 - protein, 36 aa, Hepatitis C virus
MMVVSIGVTVSSSKSFHTEWMWLTALLDRFRTSFAP

SEQ ID NO: 193 - protein, 32 aa, Hepatitis C virus
MLWWRSKELLNALMGSLLSSAAHGVIKAPVHV

SEQ ID NO: 194 - protein, 82 aa, Hepatitis C virus
MEEYDSTSDPLSPSSEAWSGRAVAVPLSTADDSELPKVLVASSAKAEDTEDSVRTTVLFLRGGGIGGALIGGNGHPCTTGGT

SEQ ID NO: 195 - protein, 186 aa, Hepatitis C virus
MGIAAGNFLDFRRISAGTDTSLSSSSARSGSKESRTTTLFSDSTRVMFPPISCRHRRLASMRSASGETWWVVHVAFKEGADNWLAEELAKEGGDPLANLRLAVSAVMWEGSVSMEVSTATSGSGSHGSCDPTRYWLSPTWNVTSSRRRGLHAGAYLCNRTPSTSEKNSGAGTWHGHFTLSVVMPVT

SEQ ID NO: 196 - protein, 107 aa, Hepatitis C virus
MGNVPCHVLLQVLGPTILMEPFLTCPVICAPHGQVVCMMPSPRQTPLYPRWHEKKGTPGSCGRSLDWSQVLKSVNTVHIQSQTSLSHEPEHGVEQSSLIHWWSLFSS

SEQ ID NO: 197 - protein, 31 aa, Hepatitis C virus
MAGSRLTRSSVEGISPLMTLKATSAPATPAP

SEQ ID NO: 198 - protein, 134 aa, Hepatitis C virus
MSTSTFPRPMLPTAAPAMPAPTKAEAALGGASWAATHPPKMLNRRVLWVVSGLVIEAVNAINDAIAGFPGRVDKPAKYCIPLMKFHMCFAQNVSRARHLDSTTGAAASACLVAVCSNPSAFCLNCSASCIPCSM

SEQ ID NO: 199 - protein, 76 aa, Hepatitis C virus
MTTLPVVRQYAARAARTPPTSTQVLVTTSRSADMHAMMYLVMGWVRVTSFWTAPSLYSKGVGPCSVGFSRMRHFHI

SEQ ID NO: 200 - protein, 26 aa, Hepatitis C virus
MWVRPVKTLSQNSRWSWQTGNPGVFR

SEQ ID NO: 201 - protein, 12 aa, Hepatitis C virus
MPEGRSPGVTNL

SEQ ID NO: 202 - protein, 19 aa, Hepatitis C virus
MPLLPLPVLPRRCERDTAS

SEQ ID NO: 203 - protein, 28 aa, Hepatitis C virus
MVKVGSKLKSTVWVTHVLQSITESKSPV

SEQ ID NO: 204 - protein, 8 aa, Hepatitis C virus
MTDTSSPR

SEQ ID NO: 205 - protein, 16 aa, Hepatitis C virus
MRCLPPLMASMGMALP

SEQ ID NO: 206 - protein, 52 aa, Hepatitis C virus
MFGCGTVTDPGGVAVASTTSRAPAVSAWSRTVPMPKIVVESVEWHSSHIMMS

SEQ ID NO: 207 - protein, 61 aa, Hepatitis C virus
MVLTPVLMLGSIPCALDIYAPNPKVAATDGLRTSTLYPWAAYAAGTLVLLPLPVGACRWAT

SEQ ID NO: 208 - protein, 41 aa, Hepatitis C virus
MDSTGTKSTAFATPRVHTAARKMPTACPEGQSSGPPEEPFK

SEQ ID NO: 209 - protein, 9 aa, Hepatitis C virus
MTSACLVTK

SEQ ID NO: 210 - protein, 12 aa, Hepatitis C virus
MMQPSRPRVCWE

SEQ ID NO: 211 - protein, 79 aa, Hepatitis C virus
MGARSRHPRPSRLSAGPRSISFPLRAETGRPKMMSPHAAVSAPQVMILVSMSEKTTGSTATARSRRPAWAQSRSGVRWL

SEQ ID NO: 212 - protein, 16 aa, Hepatitis C virus
MYVPVSAPSFMKAIWT

SEQ ID NO: 213 - protein, 71 aa, Hepatitis C virus
MPAWSTMSGPSMASRSLVMSKISSGWTAHVRRMMASRPPRTLRGGTHTCKCASALVIKYCNHHMSLARNTL

SEQ ID NO: 214 - protein, 84 aa, Hepatitis C virus
MYQAAQKNTRKERRPCAPATDAALRTTRFSKVASAWAISSIIHKQAQTRASARRRKSSRTYSHLITTETTTDPTPYRYCTSTIF

SEQ ID NO: 215 - protein, 8 aa, Hepatitis C virus
MVKLIVQG

SEQ ID NO: 216 - protein, 82 aa, Hepatitis C virus
MLHGGPPHVLVNPVLFIHVQPNQLPCGGRVLLSSSTSVSFSPQLYVGTPERSVVPTTTGLGVKQYTGPHTCDAGTIPHGWGA

SEQ ID NO: 217 - protein, 19 aa, Hepatitis C virus
MGRQLAMRSGHPDALNLCA

SEQ ID NO: 218 - protein, 29 aa, Hepatitis C virus
MNPVWRESLQFRAVLLMCQLPLVFTSWIF

SEQ ID NO: 219 - protein, 31 aa, Hepatitis C virus
MSTTACGIRSSCDTTRAVVGDQFIIISQAMR

SEQ ID NO: 220 - protein, 61 aa, Hepatitis C virus
MLLFLAASVGVSATQQREKLLSRTQGTHPGVCMIMSAASYTILELEQSFVTWYIPDTLRTS

SEQ ID NO: 221 - protein, 23 aa, Hepatitis C virus
MVKQDSKAKRKIEKEQPGRFPVA

SEQ ID NO: 222 - protein, 51 aa, Hepatitis C virus
MYPMRSAKPHVRVSMTLPKLRDLRRGSVGPQLGREPRGDRSHPAHPIPSLP

SEQ ID NO: 223 - protein, 43 aa, Hepatitis C virus
MMHGLRDLPGHSQAPYQAVPQGLSRPNTTRLAVSRGHAQISRH

SEQ ID NO: 224 - protein, 71 aa, Hepatitis C virus
MRLTDLSQLAVTRAKMEPPLKKEERKREKEGKEKKKKKKKKKKNRKWPIGLECLAPRSSVGEQVDAYPYRK

SEQ ID NO: 225 - protein, 15 aa, Hepatitis C virus
MSPDSQGWYPKFPEA

SEQ ID NO: 226 - protein, 8 aa, Hepatitis C virus
MESFNDLR

SEQ ID NO: 227 - protein, 12 aa, Hepatitis C virus
MWGRQLAGFLYG

SEQ ID NO: 228 - protein, 33 aa, Hepatitis C virus
MVAQQRVAQRVDGQLAFLRSAWRDQGACPCVGH

SEQ ID NO: 229 - protein, 17 aa, Hepatitis C virus
MVGSACRLQGRRRQLAS

SEQ ID NO: 230 - protein, 54 aa, Hepatitis C virus
MPRVAAGLRPDDPHGTVFDMSGDLCSTWAGGLHDAVSPPDSLVPALAREKRDSR

SEQ ID NO: 231 - protein, 75 aa, Hepatitis C virus
MTENEMPSPPDGFNGDGFAIEGDLSSIRQGHLLDVWVWHGDRSRRRSGGEHDKPRSSRLRLVQDCADAQDCSRVS

SEQ ID NO: 232 - protein, 57 aa, Hepatitis C virus
MALITYYDVISAPRATTIGKKLAIGRVCDGGACGNGPYPSSDVGVNTVCLRHIRPKP

SEQ ID NO: 233 - protein, 8 aa, Hepatitis C virus
MSRDQVKV

SEQ ID NO: 234 - protein, 44 aa, Hepatitis C virus
MVNGPTHAVDAGRQEGLCCGGNHLNLSLDLVLVPACKASDDATK

SEQ ID NO: 235 - protein, 28 aa, Hepatitis C virus
MVVNVRACQRAQLHEGHLDIMTPSDLPH

SEQ ID NO: 236 - protein, 36 aa, Hepatitis C virus
MNEPLSAHEVRHSGYASLEHHERTEYGEQEFGDVKD

SEQ ID NO: 237 - protein, 35 aa, Hepatitis C virus
MDRACKEDDGIAASPNIKRGDPHLQVRLGPGDKIL

SEQ ID NO: 238 - protein, 15 aa, Hepatitis C virus
MRSGHRRRIEDHQVL

SEQ ID NO: 239 - protein, 11 aa, Hepatitis C virus
MEVDQSSGQSR

SEQ ID NO: 240 - protein, 23 aa, Hepatitis C virus
MVYPGHVAHLVSGSWDGQTRQQS

SEQ ID NO: 241 - protein, 9 aa, Hepatitis C virus
MRQGPGSAS

SEQ ID NO: 242 - protein, 16 aa, Hepatitis C virus
MTPGIGRVTWVRSSIP

SEQ ID NO: 243 - protein, 61 aa, Hepatitis C virus
MTVPMTASPGSFRRRSSTSPGASRAREWEIHHGAGYRSHQMWLCSSAAPSRRACGRTSTWS

SEQ ID NO: 244 - protein, 10 aa, Hepatitis C virus
MAVGTSTAPP

SEQ ID NO: 245 - protein, 55 aa, Hepatitis C virus
MPARTFCAPRTVLGSILTPLTSNVVLGPGSRRGAWSTTLTGSGTTPAQLTIPSSR

SEQ ID NO: 246 - protein, 16 aa, Hepatitis C virus
MACHLPLQNMSFDGSG

SEQ ID NO: 247 - protein, 55 aa, Hepatitis C virus
MASYILSSFSWLLGTSKVGWSPWPPIPSPAYGPFAYCSSHCPNRLMPMMHLCKGS

SEQ ID NO: 248 - protein, 17 aa, Hepatitis C virus
MALYGLPPYSARVWCLT

SEQ ID NO: 249 - protein, 21 aa, Hepatitis C virus
MTTSPLCRIGLPTACGTWRSL

SEQ ID NO: 250 - protein, 45 aa, Hepatitis C virus
MDSPCPPDSVGRFSLAQLTATPPRGGSFSPPSPLTPSRHEVSWAP

SEQ ID NO: 251 - protein, 23 aa, Hepatitis C virus
MLRPAVEKAPKSLSRTLPRGIKC

SEQ ID NO: 252 - protein, 13 aa, Hepatitis C virus
MASIPTLGLESEL

SEQ ID NO: 253 - protein, 47 aa, Hepatitis C virus
MANSSPMGAARAAPMTSSYATNATPWTLPPSSASEQFLTKQRQPESG

SEQ ID NO: 254 - protein, 15 aa, Hepatitis C virus
MGERFPCLTSREGDT

SEQ ID NO: 255 - protein, 23 aa, Hepatitis C virus
MSSRRPFGAWAMLWHTTEGWTSP

SEQ ID NO: 256 - protein, 36 aa, Hepatitis C virus
MFPLVSEPQGCLIAWCSVSATTQGLRGMSLRQRRLP

SEQ ID NO: 257 - protein, 17 aa, Hepatitis C virus
MPTSFPKQSNRGRISHT

SEQ ID NO: 258 - protein, 26 aa, Hepatitis C virus
MRLLMKWRNVPLKRLSLKRGSGWPRC

SEQ ID NO: 259 - protein, 61 aa, Hepatitis C virus
MARAFRGPSSHSRSTLARSPPWRTSSICCLGFCLRVPWWWESSARAFCAATWGREKARSNG

SEQ ID NO: 260 - protein, 9 aa, Hepatitis C virus
MCGTGFAPS

SEQ ID NO: 261 - protein, 12 aa, Hepatitis C virus
MRSRLPLGSIHL

SEQ ID NO: 262 - protein, 15 aa, Hepatitis C virus
MMWTWWMPTCSWGAM

SEQ ID NO: 263 - protein, 67 aa, Hepatitis C virus
MPSSSWPSKPSASPLQAAIQASLQGRTPPTPAVGRPLMSWPFRRQVLPPPCPPSRGSLGIQTWSPTR

SEQ ID NO: 264 - protein, 16 aa, Hepatitis C virus
MTPSCAAPCHTPGPGP

SEQ ID NO: 265 - protein, 85 aa, Hepatitis C virus
MDMGPRRFAACPGGPLTTSSPCGRTSWKTHKHQFLRPSWPKMRCSAWTPPRGVRKQLALSFTLTSVLGSARRWPFMMSHKSFLRQ

SEQ ID NO: 266 - protein, 14 aa, Hepatitis C virus
MDSSTPPPSGWSFS

SEQ ID NO: 267 - protein, 37 aa, Hepatitis C virus
MTPDALTLPSLRETLELRRPYTRLAPCLRRPVLPYTR

SEQ ID NO: 268 - protein, 18 aa, Hepatitis C virus
MTWLSSQKARGLRRTSGT

SEQ ID NO: 269 - protein, 15 aa, Hepatitis C virus
MCLWHSAYRAAADTT

SEQ ID NO: 270 - protein, 10 aa, Hepatitis C virus
MLQLYGSAWS

SEQ ID NO: 271 - protein, 12 aa, Hepatitis C virus
MPGHLGVPPQDC

SEQ ID NO: 272 - protein, 15 aa, Hepatitis C virus
MAPVPPRFSSLLGPQ

SEQ ID NO: 273 - protein, 45 aa, Hepatitis C virus
MQLLHLPGYHHWASYGVGHDDELVTHYHHDPGLRDARPRGHHRHH

SEQ ID NO: 274 - protein, 8 aa, Hepatitis C virus
MGHFAIRG

SEQ ID NO: 275 - protein, 27 aa, Hepatitis C virus
MWHSPREVRVRPSVLFHPQPSRGGHDR

SEQ ID NO: 276 - protein, 23 aa, Hepatitis C virus
MVRLHVDELHWFHQDLWRATLPH

SEQ ID NO: 277 - protein, 26 aa, Hepatitis C virus
MWFWALAHAEFPGRLPLQALALPLHS

SEQ ID NO: 278 - protein, 89 aa, Hepatitis C virus
MGHLALLFLRLARFVDWSTPPPPKYRGRTIHVWPVTCPYKICRSMGVGSALIPSPSGRQGLRLRVDAYLAGPGRGSTREAGRLARCERS

SEQ ID NO: 279 - protein, 17 aa, Hepatitis C virus
MALLPTAPRTAPTGLCL

SEQ ID NO: 280 - protein, 12 aa, Hepatitis C virus
MGYHHILPGCGV

SEQ ID NO: 281 - protein, 23 aa, Hepatitis C virus
MRGHLTWTPRVRPTRSGDSPWPS

SEQ ID NO: 282 - protein, 9 aa, Hepatitis C virus
MDRLPRSWQ

SEQ ID NO: 283 - protein, 19 aa, Hepatitis C virus
MRRMPRRGRYHHPRHRNSS

SEQ ID NO: 284 - protein, 16 aa, Hepatitis C virus
MAQSGAILGQTHVELH

SEQ ID NO: 285 - protein, 40 aa, Hepatitis C virus
MDEQAHSLCFQRKPRRPYPLRDGVGCVAACDPTAWLPYYN

SEQ ID NO: 286 - protein, 24 aa, Hepatitis C virus
MLCEGPSGLQSCGDSCAHNAGMRR

SEQ ID NO: 287 - protein, 36 aa, Hepatitis C virus
MVGKHHPVCSNYMGPHGPDDTFFLHPYGPRHSGPGP

SEQ ID NO: 288 - protein, 15 aa, Hepatitis C virus
MSVVQPPGPPLPGEP

SEQ ID NO: 289 - protein, 21 aa, Hepatitis C virus
MCHQDHADPYSWSILDDVSQP

SEQ ID NO: 290 - protein, 22 aa, Hepatitis C virus
MGWSQLARLLQGEELCADLGGR

SEQ ID NO: 291 - protein, 15 aa, Hepatitis C virus
MDLHSVHPGEKLWRG

SEQ ID NO: 292 - protein, 99 aa, Hepatitis C virus
MGRGDVVSSGSKGYEPVHPLDRAFSRPHVAAQNARADDSHHQGTRRQNPRQQIDDVLHGGLLARHDLECDEGPRNARAIPRQDIHQHLAQAYAAYSSPH

SEQ ID NO: 293 - protein, 14 aa, Hepatitis C virus
MCESDLVGNRAQTV

SEQ ID NO: 294 - protein, 45 aa, Hepatitis C virus
MVLAHGQARRVEIRSKPYGSLRWRKLIPRSPCVVALTEHHAIKHP

SEQ ID NO: 295 - protein, 52 aa, Hepatitis C virus
MAEDQVSPSLDVRQGKRSPIEGDLTLLPEGHLLYIGMGGRHRPRGSGRGQYS

SEQ ID NO: 296 - protein, 20 aa, Hepatitis C virus
MCLGQIRPKPQGGSHRGIKH

SEQ ID NO: 297 - protein, 77 aa, Hepatitis C virus
MQVPDLVGLGHSWWCAVVTKGGRPRDDVECFNGDEVYGLSHAPRAHSCPEDPDSVAPGAKHRSPRGPLQSRKRSRGE

SEQ ID NO: 298 - protein, 43 aa, Hepatitis C virus
MLPKTVRGAQKVRAGIEVGSNAARWRATSLGETSGVHPRAAEP

SEQ ID NO: 299 - protein, 67 aa, Hepatitis C virus
MRDSTPNSGGSRVHSSGHQKDDNDLGPRSLHREVGQAEHNAPMSSTNDVYDDLGDAHHVSQDHGGSG

SEQ ID NO: 300 - protein, 73 aa, Hepatitis C virus
MPSDGTQVDGAIAFLHKPVVLRRDNEHLGCQHYPAAEVPHVESRAERSGHHDHVDVRPQALREGAALLHSHIW

SEQ ID NO: 301 - protein, 27 aa, Hepatitis C virus
MRESSGNATKRGAYDGDVPHEVGEAAR

SEQ ID NO: 302 - protein, 29 aa, Hepatitis C virus
MPGVIGAPRGTRTSGGQEPSCPAESLVPV

SEQ ID NO: 303 - protein, 33 aa, Hepatitis C virus
MCAEGRRQARVTFQLWLGGPEDSRSTPIRTFQN

SEQ ID NO: 304 - protein, 22 aa, Hepatitis C virus
MLSAPGHIPVWGGHQEGRNTWS

SEQ ID NO: 305 - protein, 29 aa, Hepatitis C virus
MLSRETPPAGRGSTGIHKMPPSLPEEAFV

SEQ ID NO: 306 - protein, 15 aa, Hepatitis C virus
MTWSSTRRSHPPRSK

SEQ ID NO: 307 - protein, 35 aa, Hepatitis C virus
MVLRARGRSFLRPSGRESPERPLWTQTLSGSHRPP

SEQ ID NO: 308 - protein, 28 aa, Hepatitis C virus
MAPIAGSPRSLPQMGVTPALSAALQPPP

SEQ ID NO: 309 - protein, 27 aa, Hepatitis C virus
MDLLAWTSIHQYRAQGHKEAETRLQMN

SEQ ID NO: 310 - protein, 34 aa, Hepatitis C virus
MRRGPPKCPRHTPPGYPPAPCPGLCCLQQPPLGH

SEQ ID NO: 311 - protein, 23 aa, Hepatitis C virus
MPSWKPQQDSLVVLTVLRGTECR

SEQ ID NO: 312 - protein, 13 aa, Hepatitis C virus
MKPPQRVVCPGPV

SEQ ID NO: 313 - protein, 17 aa, Hepatitis C virus
MRRRLPRPPQLGPTCWS

SEQ ID NO: 314 - protein, 10 aa, Hepatitis C virus
MWRCILSQDV

SEQ ID NO: 315 - protein, 19 aa, Hepatitis C virus
MRNSPPIALFGKGSGHLCV

SEQ ID NO: 316 - protein, 31 aa, Hepatitis C virus
MPQHSSPCPEGPPRAHHTFSLNGRRSSVSLP

SEQ ID NO: 317 - protein, 13 aa, Hepatitis C virus
MWSTLWPPRSSQF

SEQ ID NO: 318 - protein, 9 aa, Hepatitis C virus
MRPSPPPRR

SEQ ID NO: 319 - protein, 22 aa, Hepatitis C virus
MHHRHKPVGAVRGAVGKRAIGR

SEQ ID NO: 320 - protein, 39 aa, Hepatitis C virus
MTPAVVGCCSTGKHLSHSPPTCKWALQVYRSCPPRLGWG

SEQ ID NO: 321 - protein, 8 aa, Hepatitis C virus
MASYLLDW

SEQ ID NO: 322 - protein, 23 aa, Hepatitis C virus
MYFPLSRTGRTRGRGGPPPEAAR

SEQ ID NO: 323 - protein, 16 aa, Hepatitis C virus
MALPGGGGLEAVRHSY

SEQ ID NO: 324 - protein, 129 aa, Hepatitis C virus
MYPMRSAKPHVRVSMTLPTLRDLCRGSLGPQEGREPRGDRSHPAQPSPSFPYRGQGYPGFPQDLPVERRSLGMGWRLPRGWDRSEVFLVVRTPNLGPLRGNKYTPPTIWPPPGNLTSCGRRLVFLLVFL

SEQ ID NO: 325 - protein, 177 aa, Hepatitis C virus
MSPPPAPTVNQLDKSRRRASGNGVSLSLVFTAQLKRYRPQTAALPPREMRDALTARARLFHALRGGAPSFLRAEATRVSSWGVYVCRRKASSPCNLSIMAGRSRGLTEYTDPYISKLRSWSRVSWAIRMEKKCVIRTMRTHIVGAYWMMFPNHELTGECLTVSQAARAIGVVGSLVR

SEQ ID NO: 326 - protein, 27 aa, Hepatitis C virus
MTTKSSPHTSIVGATIPAALQAARAFT

SEQ ID NO: 327 - protein, 32 aa, Hepatitis C virus
MVFPMLVVSTPLARQRLYPQVWPLLLNIGPPT

SEQ ID NO: 328 - protein, 62 aa, Hepatitis C virus
MAVRASSGKEQAWYMASSVLMSLSVTVESKHRVSYEKPIGSFLSAHAFKRNSTRWAGEYWNP

SEQ ID NO: 329 - protein, 75 aa, Hepatitis C virus
MMVVGIGVCESSRRSFHTDLMWLTALPDKLRTSLAPYPYLDLAEWGGVNWHASSKVRSFALTLEAASLMSFKTES

SEQ ID NO: 330 - protein, 138 aa, Hepatitis C virus
MEQHTTESSSSEQVDQDPESEPGAASPPWEGGRSSTWSGSRSGSPGSPSRGGMEEVEPVSERANSSGGVRPPESAASAPVERPESPLGGGWPKVLMASCWRASPMVLSLRPTVRRLLGGGVGVFLGGGRAQPATVGGW

SEQ ID NO: 331 - protein, 11 aa, Hepatitis C virus
MNRLASTMSTS

SEQ ID NO: 332 - protein, 15 aa, Hepatitis C virus
MDINTSVSGSGSQGS

SEQ ID NO: 333 - protein, 17 aa, Hepatitis C virus
MAVLKFGAGFGMHWPSV

SEQ ID NO: 334 - protein, 20 aa, Hepatitis C virus
MLAPQGHRVVMMPVPAHTPL

SEQ ID NO: 335 - protein, 53 aa, Hepatitis C virus
MVQTQSHTSRSHEPAHGMGQSSVIQLWSLLSRLVIVREPSSWVTRCDASDSVT

SEQ ID NO: 336 - protein, 147 aa, Hepatitis C virus
MSLFIHWTAPSPGPTWRRRMPAQMTPTTRAPGDKIPGSRLMTSSMEGFSPDMILNATRAPEMPAPYPARISTSTLPRPMLPTAAPTRPLTTKPVAPAGGAIWDASQPPRMLRRIVVLVDNGLVRAALNAIMEATAGFPGSVDSPARY

SEQ ID NO: 337 - protein, 70 aa, Hepatitis C virus
MPLMKFHMCLAQNCSTLGHEASTAGCMSWACLEACCNKPWILDFSISAIRCPSSMRAALEAHSSISSKAS

SEQ ID NO: 338 - protein, 98 aa, Hepatitis C virus
MCKRPMMETHPVAKQYAATAAKTPPARTHVLVMTSRSACMHVAMYFVTGCVKVTSLVTEPKRYRRGVGPTRVGLSRVRHFHMTSQDGGGALALAHTVA

SEQ ID NO: 339 - protein, 47 aa, Hepatitis C virus
MCVRPVKTASQNSRWSWHTGKPGVLKYALSLTVVSAGVSSYHAAPAS

SEQ ID NO: 340 - protein, 12 aa, Hepatitis C virus
MRASVATTTTSP

SEQ ID NO: 341 - protein, 26 aa, Hepatitis C virus
MPRRAAASSSHFFFEWQKIKCLPPLM

SEQ ID NO: 342 - protein, 19 aa, Hepatitis C virus
MPRMVVASTAWHSSHMMMS

SEQ ID NO: 343 - protein, 68 aa, Hepatitis C virus
MAAPVVTVLTPVLMLGLMPCALDKYAPNPRVAATEGLSTSTLYPWAAYATGTLVLFPLPVGACKYRTW

SEQ ID NO: 344 - protein, 121 aa, Hepatitis C virus
MSSASTGMKSMDLATPREHTAARKIPTAWPLGQSTGPPEDPFKVERGLGESNAPRLSPRLRAGMTSAFRVTRYRSTAPHEHGSKDLVPGGLGHPTKSPSALEYICVTGPREPARVLLPAPW

SEQ ID NO: 345 - protein, 42 aa, Hepatitis C virus
MDVPRKDWVTVDRTWISPACSVLSRPVMLTTMAPKRPRVCWA

SEQ ID NO: 346 - protein, 11 aa, Hepatitis C virus
MGARSFHPLEV

SEQ ID NO: 347 - protein, 46 aa, Hepatitis C virus
MSPHAAVSAPQTMTFFSIGLKMIGSTATAKSRRPLAAQSDIGARWS

SEQ ID NO: 348 - protein, 30 aa, Hepatitis C virus
MSNTTPGQNMVVAHIMPSRPPRACMGGTHS

SEQ ID NO: 349 - protein, 8 aa, Hepatitis C virus
MASPRVRR

SEQ ID NO: 350 - protein, 154 aa, Hepatitis C virus
MYQAATKKMTKYRKPLQLAALAACKTTSFSSAASAWPSKISIHTQAQTLASARRRNKSTTHSHRTTYFVRAGDRPYMYCTSTIFWWRWSRPVDKAGKSEKEQGKMAHSVVECNRGDSWLLSLSSKSQRSPRVKLHAAVSLCSIPPTYILILKME

SEQ ID NO: 351 - protein, 44 aa, Hepatitis C virus
MRQGGAPQVLVKPVEFIHVQPNHDPRGGRVLFNRKTSVSFSPHV

SEQ ID NO: 352 - protein, 28 aa, Hepatitis C virus
MCQLPLVLISWMFCLEPGERRPAKLSVL

SEQ ID NO: 353 - protein, 13 aa, Hepatitis C virus
MTTTLAHAPCIEK

SEQ ID NO: 354 - protein, 12 aa, Hepatitis C virus
MMSMMTSGTRIT

SEQ ID NO: 355 - protein, 55 aa, Hepatitis C virus
MVVVGDQFIIMSHAIRCPVMVPRMEQLHSCTNQWCSGEIMNIWAASITPPQRSPT

SEQ ID NO: 356 - protein, 47 aa, Hepatitis C virus
MSMCVRKPCVRAPRCCTATFGETGIQHRDVFPTLSHGTHPGTWRTAA

SEQ ID NO: 357 - protein, 11 aa, Hepatitis C virus
MLSLEQSLVTM

SEQ ID NO: 358 - protein, 23 aa, Hepatitis C virus
MVIQDSRASKKIEKEQPGRFPVA

SEQ ID NO: 359 - protein, 129 aa, Hepatitis C virus; identical to SEQ ID NO: 324

SEQ ID NO: 360 - protein, 28 aa, Hepatitis C virus
MGATLRHESLPCEELLSSRRKRLAMALV

SEQ ID NO: 361 - protein, 76 aa, Hepatitis C virus
METRVAVGQVGSCPLAGLVLLGAPATPGIDHAIWAGSSTPSRVVLPISWGTSLSLAPLSEASPELWHTVLGSWKTG

SEQ ID NO: 362 - protein, 78 aa, Hepatitis C virus
MQRGIYPVALFLSSYLLFCRALQCQCLQWKSGTSALATTPLMIARTTASPGSSLTQFSIFLDVSHARMTMVPCAAGYK

SEQ ID NO: 363 - protein, 31 aa, Hepatitis C virus
MRPPIPPARQWAGPLGALLASLSLVPNRTSN

SEQ ID NO: 364 - protein, 54 aa, Hepatitis C virus
MTACTRVSWPPCFMPTNSTALAAPSVCLPAVGWMIFVSGGEPWNTRPTSPMLKT

SEQ ID NO: 365 - protein, 12 aa, Hepatitis C virus
MLPMLSVEQGPG

SEQ ID NO: 366 - protein, 11 aa, Hepatitis C virus
MDFLQLLRNTS

SEQ ID NO: 367 - protein, 15 aa, Hepatitis C virus
MGRCGSSSFLRRPGT

SEQ ID NO: 368 - protein, 56 aa, Hepatitis C virus
MTTSPPCQLGRPRVCGTWRLPWSLSCSAQWRRRSSCGGLRQWHVETSCMASRFPRG

SEQ ID NO: 369 - protein, 10 aa, Hepatitis C virus
MATPPRGGSS

SEQ ID NO: 370 - protein, 67 aa, Hepatitis C virus
MSRPGRSRFCPPSHNPSWGHLFRGFSGRYITGLVTRPWLAPEDQSPRCTPAQRGTSWDGLVPPGLSH

SEQ ID NO: 371 - protein, 108 aa, Hepatitis C virus
MIDGVHCCRQGLSQPSKDHPEDPCSALGDTPWACSERPCAPGVWPNLLTSSRLNLSTSLDGRPVFLTTARHQLCPKLTRWATCTHRQVAGRAPRSLPHIPVRGIKCSC

SEQ ID NO: 372 - protein, 50 aa, Hepatitis C virus
MASFSRMEAAQPAPMISSSATSAIQWTLPPSLASEQSLTRLRPQVLGWWF

SEQ ID NO: 373 - protein, 13 aa, Hepatitis C virus
MRARSLFMARLSL

SEQ ID NO: 374 - protein, 31 aa, Hepatitis C virus
MSSQQPFGAWASMPSPTTGVSTSPLYQLKGT

SEQ ID NO: 375 - protein, 14 aa, Hepatitis C virus
MSHQAKGRLGCSTA

SEQ ID NO: 376 - protein, 16 aa, Hepatitis C virus
MMPGQLGTSLRLLRLR

SEQ ID NO: 377 - protein, 17 aa, Hepatitis C virus
MPTSSPRRSKEEITLRI

SEQ ID NO: 378 - protein, 44 aa, Hepatitis C virus
MIRWLWPLTRKSYMRPLMRWKNAPPKPPSLRKGSGWRRCLNLRY

SEQ ID NO: 379 - protein, 16 aa, Hepatitis C virus
MLPLLTTWRSLTPRCA

SEQ ID NO: 380 - protein, 15 aa, Hepatitis C virus
MIVTWWMPTFSWEAM

SEQ ID NO: 381 - protein, 11 aa, Hepatitis C virus
MIVSLLYHQST

SEQ ID NO: 382 - protein, 114 aa, Hepatitis C virus
MWRGSLGRWQTKCSALSKTPMTPVTPLGRIPEETASSSPLARLPLQMRDHCPPCLPLRGSRGTLTWSLSQRDPLPLPRGSVRSSTRTLSRGLQSPIKRILLSAAPCHTPGQEPS

SEQ ID NO: 383 - protein, 21 aa, Hepatitis C virus
MTQSCRTLSGLPLRLVRGSSQ

SEQ ID NO: 384 - protein, 44 aa, Hepatitis C virus
MRCSVLIPPRAEKSQLASSYTLTLGSGCAKRWPFMTLHKSFPRQ

SEQ ID NO: 385 - protein, 42 aa, Hepatitis C virus
MGSNTLLQNGSIFSSKLGEVRRTQWGSHMTPAASTQPSRRGT

SEQ ID NO: 386 - protein, 40 aa, Hepatitis C virus
MGLTPSHCTHTLPTNSHGWQRLSGNLERLPLERGRVGRVL

SEQ ID NO: 387 - protein, 15 aa, Hepatitis C virus
MPDPAYYSFAYSYLA

SEQ ID NO: 388 - protein, 16 aa, Hepatitis C virus
MNHSPVRNYCLHAESV

SEQ ID NO: 389 - protein, 12 aa, Hepatitis C virus
MSGHLGVPPQDC

SEQ ID NO: 390 - protein, 84 aa, Hepatitis C virus
MGHDAELVTNSYHDPRLRCSCSRVGPGNCLRRPLGCGIWLGLFLHAGSVGQGHCHPPSCCGSGCDHLFHRRDSGPDRWELCWPL

SEQ ID NO: 391 - protein, 18 aa, Hepatitis C virus
MRYRPSSVGLRAGLLLYS

SEQ ID NO: 392 - protein, 8 aa, Hepatitis C virus
MRSTTLPH

SEQ ID NO: 393 - protein, 19 aa, Hepatitis C virus
MHRKFHHLQGADVCRGGGA

SEQ ID NO: 394 - protein, 13 aa, Hepatitis C virus
MQFHTRRPLQIGR

SEQ ID NO: 395 - protein, 68 aa, Hepatitis C virus
MLLLRPTGTIYWPVAPSPKHRGRAVPLWTFSSCYEIHRKVGMGGPPFPVAGRRQDLCMPLDAHHTGPS

SEQ ID NO: 396 - protein, 11 aa, Hepatitis C virus
MGSPPGGPRGA

SEQ ID NO: 397 - protein, 15 aa, Hepatitis C virus
MWRHPAWPPGFREAR

SEQ ID NO: 398 - protein, 30 aa, Hepatitis C virus
MGPGWGGASRRGSLLPGDRLHLHHWPHTPE

SEQ ID NO: 399 - protein, 8 aa, Hepatitis C virus
MRLQSRPH

SEQ ID NO: 400 - protein, 45 aa, Hepatitis C virus
MAQDRTILGQTHVELHQWHTVPGGTLHLTGKSRSGINDGFQRRIN

SEQ ID NO: 401 - protein, 20 aa, Hepatitis C virus
MFGVLAPGHLGVGMFHSHRL

SEQ ID NO: 402 - protein, 46 aa, Hepatitis C virus
MRSKHLGPRPLGHHENNRPEDLPKHVAGNLPHQLLHRRALCAKTPS

SEQ ID NO: 403 - protein, 14 aa, Hepatitis C virus
MWARGGEVANQPSE

SEQ ID NO: 404 - protein, 15 aa, Hepatitis C virus
MSVVQPPGPPLPGEP

SEQ ID NO: 405 - protein, 46 aa, Hepatitis C virus
MRLTDLSQLAVTRAKMEPPRKEEKKKIRKKRKKKKNKKKKKKKKEN

SEQ ID NO: 406 - protein, 22 aa, Hepatitis C virus
MCAMRRRQAHVAFQLWPAGLVD

SEQ ID NO: 407 - protein, 8 aa, Hepatitis C virus
MSWCSPCW

SEQ ID NO: 408 - protein, 13 aa, Hepatitis C virus
MRTPLGPSYFPKL

SEQ ID NO: 409 - protein, 64 aa, Hepatitis C virus
MSRSQEGCSLDGPREVVPVGTFSSWSSTLMVQKAHDHPLPQSWNRGSQERSPWSRTQFGSHRLP

SEQ ID NO: 410 - protein, 8 aa, Hepatitis C virus
MPFYGWYR

SEQ ID NO: 411 - protein, 19 aa, Hepatitis C virus
MPLRDFPVRWRVPPGTVCH

SEQ ID NO: 412 - protein, 23 aa, Hepatitis C virus
MMTAWLAVCPGPVLWPVVGGLVS

SEQ ID NO: 413 - protein, 31 aa, Hepatitis C virus
MRHTCKCPIAPSQFSLYVDYGRQRPEGQSEW

SEQ ID NO: 414 - protein, 39 aa, Hepatitis C virus
MRQGPWCSSRYLSVRAGSPPGKFGAQLVACCCQKNWASV

SEQ ID NO: 415 - protein, 12 aa, Hepatitis C virus
MHPVYHLSSGPE

SEQ ID NO: 416 - protein, 9 aa, Hepatitis C virus
MPLSQPPTR

SEQ ID NO: 417 - protein, 8 aa, Hepatitis C virus
MAPVVETL

SEQ ID NO: 418 - protein, 15 aa, Hepatitis C virus
MWPRGPLCPLSTRPP

SEQ ID NO: 419 - protein, 24 aa, Hepatitis C virus
MHRSWRLPATGKGGPPIPTLRCIS

SEQ ID NO: 420 - protein, 30 aa, Hepatitis C virus
MATPPTQWWSAAVDSADPYPYLPICSGLRV

SEQ ID NO: 421 - protein, 16 aa, Hepatitis C virus
MLQRIYAPPPLHTSAP

SEQ ID NO: 422 - protein, 24 aa, Hepatitis C virus
MDNATVCKGSLSGTWGSTRALLHT

SEQ ID NO: 423 - protein, 17 aa, Hepatitis C virus
MALGGNASSTASCLQHW

SEQ ID NO: 424 - protein, 11 aa, Hepatitis C virus
MGHIQEDGELR

SEQ ID NO: 425 - protein, 16 aa, Hepatitis C virus
MALPGGGGLEAVRHSY

SEQ ID NO: 426 - protein, 25 aa, Hepatitis C virus
MICRETSYGTLCSHAAHGPFTASRD

SEQ ID NO: 427 - protein, 23 aa, Hepatitis C virus
MPTPTLSRSRQRSNRRGRACDTL

SEQ ID NO: 428 - protein, 36 aa, Hepatitis C virus
MSPPPAPTVNHPDKSRRLASGNGVSLSFVFTAQLKR

SEQ ID NO: 429 - protein, 217 aa, Hepatitis C virus
MMSEALTARARLFHALRGGAPSFLRVAATRESSWGEYVCNEKASSPCSLSIMAGRSSGLTEYTAPYISKLRFWFRVSWASSMEKKWVIMTIRTQIVGAYWMMLPSQELTGECLTVSQAARVIGVVGSLVKKYRRRPRESSATDTFEEQDVISSKSYSGLGRSPGGAEYLVIASVKALRFRSSSSLPWLSEMTTRSSPHTSIVGSTIPAALHAARALM

SEQ ID NO: 430 - protein, 17 aa, Hepatitis C virus
MVFPMLVVKTPLARQRL

SEQ ID NO: 431 - protein, 48 aa, Hepatitis C virus
MDSSVLMSLSVTVESKQRVSYENPIGSFLLPQALRRKSTRSAGEYWNP

SEQ ID NO: 432 - protein, 96 aa, Hepatitis C virus
MRRAGFFPPLAGSIQNTSFLAMAVVSIGVCWSSRRSSHTDRMWLTAPLDKLRTSFAPNPYRDLAEWGGVNAQASSTERSLALTLEAARLTSCKTES

SEQ ID NO: 433 - protein, 18 aa, Hepatitis C virus
MRAPVQEYDMEQQITESS

SEQ ID NO: 434 - protein, 59 aa, Hepatitis C virus
MTSHSPSEGGADLAGSNSRSGSPGSPSRGGMEDSDPASEAAVSPEGCWTLSPPVSAPVE

SEQ ID NO: 435 - protein, 96 aa, Hepatitis C virus
MESRESRTITLESDSIRVTSPPMKRLASTMSQSYAVLWVVQVAFKDGADSWLAEELACEGGDPLASRLAAVSAVMWDGSVNMEANTSVSGSGSQGS

SEQ ID NO: 436 - protein, 128 aa, Hepatitis C virus
MGKVPCHMFRQVFGPVIFMVPKRTWPEMFAPHEHRVVMTPVPAHTPLYPFWQEMKGRPGILGSNFADSQFLKSVRMEHTHSQMSRSQDPEHGTGQSSVIQACSLLSKLVIVSELNTCVTRSEASDSAT

SEQ ID NO: 437 - protein, 206 aa, Hepatitis C virus
MTPTTKAPGDKIAGRRFTTSSTEGFSPLMILKATRAPEMPAPYPARTSTNILPRPILPTAAPTRPLTTKPVAPAGGAIWEANHPPMMFKRMVVLVGSGLVNAALKAIIDATAGFPGKVESPARYCMPLMKFHMCLAQNCSILGHDDCMAGCMSWACFVACCRRPSILDLSISAIRCPSSMRAALEAHSSISSKASYKISLSGATTT

SEQ ID NO: 438 - protein, 13 aa, Hepatitis C virus
MRPMMEMQPVARQ

SEQ ID NO: 439 - protein, 66 aa, Hepatitis C virus
MTSRSACMHVAIYFVTGWVRVISLVTAPKRYRRGVGPVSVGFSLVRHFHITSHEGGGAFALAHTVA

SEQ ID NO: 440 - protein, 16 aa, Hepatitis C virus
MCVRPVKTASQNSRWS

SEQ ID NO: 441 - protein, 12 aa, Hepatitis C virus
MVKVGSRLKSTI

SEQ ID NO: 442 - protein, 23 aa, Hepatitis C virus
MTESKSPVYPVIRASVATTTTSP

SEQ ID NO: 443 - protein, 34 aa, Hepatitis C virus
MPRRAAASSSHFFFEWQNIRCLPPLMEARGIALP

SEQ ID NO: 444 - protein, 52 aa, Hepatitis C virus
MLAWGVVTVPGGVAVARTTSLTPAVSAWSRTVPMPRMVVASTEWHSSQMMIS

SEQ ID NO: 445 - protein, 11 aa, Hepatitis C virus
MLGLIPWALDM

SEQ ID NO: 446 - protein, 72 aa, Hepatitis C virus
MSRDSTGMKSIDLATPLAHTAALNKPTACPLGQSTGPPDDPLRVERGLGDSNAPRLSSFLRTGMTSAFRVTR

SEQ ID NO: 447 - protein, 9 aa, Hepatitis C virus
MAPRRPRVC

SEQ ID NO: 448 - protein, 11 aa, Hepatitis C virus
MGAKSFHPLEV

SEQ ID NO: 449 - protein, 46 aa, Hepatitis C virus
MSPHATVSAPHTMTFFSIGLNTTGSTATARSRKPWAAQVDKGERWS

SEQ ID NO: 450 - protein, 25 aa, Hepatitis C virus
MVINSIWIYLAPARCLTRVHTRSRA

SEQ ID NO: 451 - protein, 21 aa, Hepatitis C virus
MTATQMIPSRPPRASRGGTHC

SEQ ID NO: 452 - protein, 20 aa, Hepatitis C virus
MDMIINMTSPSSPCSAASKA

SEQ ID NO: 453 - protein, 67 aa, Hepatitis C virus
MKNHSGPLALAALAECKMMSFSSAASAWPSMMSIQRHAQILASASNRKRRTTHSHFTMYFVTAGESP

SEQ ID NO: 454 - protein, 8 aa, Hepatitis C virus
MVKFTVHG

SEQ ID NO: 455 - protein, 44 aa, Hepatitis C virus
MRQGGAPHVLVNPVPFIQVQPNQAPRGGLVLFSRKTSVSLSPQL

SEQ ID NO: 456 - protein, 41 aa, Hepatitis C virus
MSSTLVTLVSYSKVPHPIRKSSSPRQEDKRSGQPELLNLLA

SEQ ID NO: 457 - protein, 52 aa, Hepatitis C virus
MKPVCKLSLQLRAVRFMCQLPLVLINWTFCWAPSLKRPAKLPTVRPTVAPVE

SEQ ID NO: 458 - protein, 13 aa, Hepatitis C virus
MAMTLAHAPCMEK

SEQ ID NO: 459 - protein, 20 aa, Hepatitis C virus
MVRVGDQFSIMSHAMRWPVI

SEQ ID NO: 460 - protein, 52 aa, Hepatitis C virus
MEQLHSWVKLWRSGDTIRACDTIITAPHTSPTYRAEQTVAAITITSTCARRL

SEQ ID NO: 461 - protein, 10 aa, Hepatitis C virus
MLLFEQSLVA

SEQ ID NO: 462 - protein, 33 aa, Hepatitis C virus
MFLISTEDTGTVTHDRRASKKIEKEQPGKFLVA

SEQ ID NO: 463 - protein, 102 aa, Hepatitis C virus
MYPMRSAKPHVMVSMTLPKLRDLCRGSLGPQVGRDPRGDRSQPAQPQPSFPYRGQGYPGFPQDLPVERRSFGMGWRLPRGWDRSEVFLVARTPNLGPLRGSK

SEQ ID NO: 464 - protein, 19 aa, Hepatitis C virus
MRHAVKDVAPAGAHGEPPG

SEQ ID NO: 465 - protein, 20 aa, Hepatitis C virus
MLVFQEVLPHGPDVVNGPPG

SEQ ID NO: 466 - protein, 31 aa, Hepatitis C virus
MEPHKRVTQRADWQLLLLGPTWCYEGSCPGV

SEQ ID NO: 467 - protein, 16 aa, Hepatitis C virus
MGGTGSLQGRGGQLAR

SEQ ID NO: 468 - protein, 43 aa, Hepatitis C virus
MLRDLNVLRRCHPPNSGLIIRRGFWHTRPFCVTIDGEGSLPHV

SEQ ID NO: 469 - protein, 45 aa, Hepatitis C virus
MVSPRGKGDQSVHPLDRPLSLADVAAQDCCANDSHYQGARGQNSR

SEQ ID NO: 470 - protein, 14 aa, Hepatitis C virus
MGQGNLVGHGTQAV

SEQ ID NO: 471 - protein, 23 aa, Hepatitis C virus
MTKGHLLYVSVGSCHRTGGRGCG

SEQ ID NO: 472 - protein, 13 aa, Hepatitis C virus
MALVADDDIIGAG

SEQ ID NO: 473 - protein, 41 aa, Hepatitis C virus
MQDVSTCHCLSPPHDDLLLHWAEHDRLHGNRQVPQTLGRPS

SEQ ID NO: 474 - protein, 8 aa, Hepatitis C virus
MSHQGTHS

SEQ ID NO: 475 - protein, 59 aa, Hepatitis C virus
MLHPPYIHPHLEDGEIYGAWIMPQSVRVVYQAPGGQPGPCSTLNIGSIWVLPKTVCRAQ

SEQ ID NO: 476 - protein, 77 aa, Hepatitis C virus
MPAVRPHVFNIGDVGLVFQGSPPDTKIIQPTAGRQTLGAARAVEFVGIKQGGHETRVQAVIAVEGGPVYVPAAVGID

SEQ ID NO: 477 - protein, 25 aa, Hepatitis C virus
MAAEDNFQDQLGNTSSVGEDHGKSW

SEQ ID NO: 478 - protein, 121 aa, Hepatitis C virus
MTLVDGTVALLGKVVAFWRYYKSLRHDHHGPTHISHVQSRADRSCHYDHIDVCSQVVSECTAVFYSHIRCYLYPAAQGTIVILAWDTSRKMENCVSELPGDAVVRAIISGVVASADVPDFH

SEQ ID NO: 479 - protein, 156 aa, Hepatitis C virus
MPGVAGAPSRTRPARGQEPTCPTATLVSIQRPRISWLSPGLAGGAPIFRDGLASPTRLGSLGSLPCRAHTQPGAPARQQVNSANDLAATRELDVLWAAVCVSFGFSLRFRICAHGARSTRPPGALASTLSGSTTRPFATQRYSASSLAGARPNDRT

SEQ ID NO: 480 - protein, 25 aa, Hepatitis C virus
MALVRVSCSLQAPPSRESHSGLRNR

SEQ ID NO: 481 - protein, 69 aa, Hepatitis C virus
MVMRAAGGQGGSCPRAAPVHLGAQMTPGGGPAIWVKSSIPLRVDSPTSWGTSRSSAPPWEASQEPSRMA

SEQ ID NO: 482 - protein, 28 aa, Hepatitis C virus
MRPMTSFCTHPAAYLVFRTTIYPRAGPQ

SEQ ID NO: 483 - protein, 33 aa, Hepatitis C virus
MPPEGLLAFLVWAPNRNCSWLTPMARGTSTALP

SEQ ID NO: 484 - protein, 43 aa, Hepatitis C virus
MLTSPVLLMTNRTAGTTHLDLVKLSRHQVSAVLYTASHHRQWS

SEQ ID NO: 485 - protein, 35 aa, Hepatitis C virus
MPRACQPTPGVRMIPMCSCWSPCGLPVVGGLGARG

SEQ ID NO: 486 - protein, 36 aa, Hepatitis C virus
MGVGGIPEMSQTSSAPPTASGNILRPHTAGVVRGPG

SEQ ID NO: 487 - protein, 16 aa, Hepatitis C virus
MSNTFMALDLAWWDGR

SEQ ID NO: 488 - protein, 68 aa, Hepatitis C virus
MRGRVKTALLSALGSWPSSASLPYHPGTSIGSAALYGGTSTPYVDASPPSKCGSPPYLHAGVGTVSSC

SEQ ID NO: 489 - protein, 28 aa, Hepatitis C virus
MTIGRWVGDCWPRSQHTPSKLGAFLGLL

SEQ ID NO: 490 - protein, 21 aa, Hepatitis C virus
MVQVRERSRAPNIPRSKCTQM

SEQ ID NO: 491 - protein, 53 aa, Hepatitis C virus
MPMSSLLGAGGTPQRACSVLDLSPVSKVPLEVLLCALRGMLQGSLGLLCAPEV

SEQ ID NO: 492 - protein, 25 aa, Hepatitis C virus
MPRPAAVKAQRSRPLTWHKDILFSC

SEQ ID NO: 493 - protein, 19 aa, Hepatitis C virus
MGSTPTSALGTAPLQLVPN

SEQ ID NO: 494 - protein, 17 aa, Hepatitis C virus
MNVMPKTLLAYWVSARS

SEQ ID NO: 495 - protein, 11 aa, Hepatitis C virus
MCPSYQQQETS

SEQ ID NO: 496 - protein, 59 aa, Hepatitis C virus
MRFPAANVVAVRAEVDSVHTDMSPPVKDRLECLTRLFSVSAMTRAARGTISSPLRPQSD

SEQ ID NO: 497 - protein, 17 aa, Hepatitis C virus
MPTFCHRLSSRDLTSRT

SEQ ID NO: 498 - protein, 36 aa, Hepatitis C virus
MDLRPFYIGWGLSKMKSACHTPSQNTSWHACQLIWK

SEQ ID NO: 499 - protein, 18 aa, Hepatitis C virus
MRWRSAHKPPRTSSKLRQ

SEQ ID NO: 500 - protein, 41 aa, Hepatitis C virus
MELVSQAPWWLLRSWEENSPPLRTWSTCCPPYYLRVLSSSV

SEQ ID NO: 501 - protein, 14 aa, Hepatitis C virus
MFPRAMLQRGSPHC

SEQ ID NO: 502 - protein, 59 aa, Hepatitis C virus
MKZTQALVVTTGCVSSGTGFVRCCPTSSHGSLLRLCQRSPGCPSFPVKRDTRACGGGTA

SEQ ID NO: 503 - protein, 87 aa, Hepatitis C virus
MGPCGLQGRVHVLTCGTVLSPSMSTPPDPVHLVHHPTTLARYGAWLPTATLKCAEWGTSIILRGPQKMSSSVRAKYRLLSSSLKWMG

SEQ ID NO: 504 - protein, 83 aa, Hepatitis C virus
MTPSSRWLQSVSRNLPSILQPFLSGLGQTTILHCWTAGKLRIMYHQLSMDVPYHHGALRRSLLLGGKEQFSWTVPMCPRRYVR

SEQ ID NO: 505 - protein, 33 aa, Hepatitis C virus
MTPAALTQLSLNRTSGWKRRYTNAATLNRRPGK

SEQ ID NO: 506 - protein, 18 aa, Hepatitis C virus
MIWSWWPRVTASMRMGQP

SEQ ID NO: 507 - protein, 40 aa, Hepatitis C virus
MLHSPPTTLSSSHLAPPTSPWHGTTRGGGTITSPVMPPLP

SEQ ID NO: 508 - protein, 16 aa, Hepatitis C virus
MDHSPVRNFCLHAESA

SEQ ID NO: 509 - protein, 24 aa, Hepatitis C virus
MPSKAQQLQAHHFLQAGVGSLDRC

SEQ ID NO: 510 - protein, 38 aa, Hepatitis C virus
MYSQFHIVQGEDVRGWVRAPVYRRLQLDQGGALRYRRS

SEQ ID NO: 511 - protein, 101 aa, Hepatitis C virus
MGAEMGVRHPHFPPPSGPTRVRCPLADADDNTSRSSLGEPCHAERRRRCWDTRYRLVPGGLLCGVVRAGQTCPGGDLQPDGPLAPSFARPHAPPTGVCVVG

SEQ ID NO: 512 - protein, 8 aa, Hepatitis C virus
MVEPVHHM

SEQ ID NO: 513 - protein, 17 aa, Hepatitis C virus
MRVRPPSVGPPLTCTRE

SEQ ID NO: 514 - protein, 68 aa, Hepatitis C virus
MRCHTTPTRRTWGGGGTVDEQAHRIRIPGQPRFTNALCSRERCCSEGHRIAEFSNCHKPAPAVTPVDQ

SEQ ID NO: 515 - protein, 9 aa, Hepatitis C virus
MARGCQQLR

SEQ ID NO: 516 - protein, 48 aa, Hepatitis C virus
MCLTTTGRSAGPSSSEEKNNSAGRFQCVRGVTCASGKIISVLETAGRE

SEQ ID NO: 517 - protein, 24 aa, Hepatitis C virus
MLIHASSRGRTGRSGLELRLLVHR

SEQ ID NO: 518 - protein, 8 aa, Hepatitis C virus
MESFNDCW

SEQ ID NO: 519 - protein, 24 aa, Hepatitis C virus
MVVEHLQSVEGNLPLTLRSASRRR

SEQ ID NO: 520 - protein, 67 aa, Hepatitis C virus
MMSQQGVAEWADGQFLLLSTTRCYQGAGPRVRHRAADHALLLAVTNGGPRVATQVRIARFSLERRHG

SEQ ID NO: 521 - protein, 57 aa, Hepatitis C virus
MDSWWYIIRSFPAVQQWRIVVWPSPDRKGWRILGRFLETLCSHRELGVISFGPQRFE

SEQ ID NO: 522 - protein, 14 aa, Hepatitis C virus
MRPMRLASGLQRRS

SEQ ID NO: 523 - protein, 39 aa, Hepatitis C virus
MRRVSQHRGQHRNIWFWLTGELRSYRVGIQPYRESDLLS

SEQ ID NO: 524 - protein, 18 aa, Hepatitis C virus
MEVPHSAHFNVAVGSHAP

SEQ ID NO: 525 - protein, 45 aa, Hepatitis C virus
MTGYCCPARTACRHHAVPPPHALVSLLTGNEGQPGERWHNLSREP

SEQ ID NO: 526 - protein, 23 aa, Hepatitis C virus
MGGNPPPEYVEKHSLVGRQGTGD

SEQ ID NO: 527 - protein, 52 aa, Hepatitis C virus
MLVPEGLKLLPVGSYYGLNDSLLLGGSLQQSKDFFLELVGYCLSLLDVRGGL

SEQ ID NO: 528 - protein, 9 aa, Hepatitis C virus
MTHNHNAAD

SEQ ID NO: 529 - protein, 49 aa, Hepatitis C virus
MAKDKVPPPLEQGYRYSLTVEGDLTFRAQGHFFDVRMWHSDAAWGSSCR

SEQ ID NO: 530 - protein, 57 aa, Hepatitis C virus
MTFITDNHIVCPPGATPVREKLTVGGIGQFGTSCNGAVPSADVGVDPIGTRHERAKA

SEQ ID NO: 531 - protein, 15 aa, Hepatitis C virus
MKVSYLIALWNSRRS

SEQ ID NO: 532 - protein, 45 aa, Hepatitis C virus
MPRRAHNRTSRGTFETGERSRTEQARCGVPPAPSRDDIGIAGNQV

SEQ ID NO: 533 - protein, 25 aa, Hepatitis C virus
MFGARERSRTCTMVNSPRNPPHCCT

SEQ ID NO: 534 - protein, 90 aa, Hepatitis C virus
MQQWMLLAAVTIFDIAALPPGPVASGGKPVLEPTHEHPHLEQCEIDCTWVMPKPVWIVDHAAGCQPGPRTTPAVCGLRMFPEAVGGAEEV

SEQ ID NO: 535 - protein, 66 aa, Hepatitis C virus
MIIKQPSYEPGVYGLITVQGSAVDVPRAIGVNQLQFLLGAHTKKASKPSGGMSCRATGGICYGIDP

SEQ ID NO: 536 - protein, 38 aa, Hepatitis C virus
MGPGYYVEQGLGHPQDVRHRHTQSGEPIHHHIPSHSMS

SEQ ID NO: 537 - protein, 69 aa, Hepatitis C virus
MTTYRSGGCSDVPDCHCRCHWGPARGYIVVLNTRYAAGCVQNDVIGLIHNTAIGTVVGEDVEARRIPPL

SEQ ID NO: 538 - protein, 97 aa, Hepatitis C virus
MREGSCDASHGGADERDVPHEVGESTRKGIDDFTQIAGPPPGVIWAPRWTGAARGQEPPCPPAALITIEGPRVPGLSPGPASALTRLGDRLSSSAGL

SEQ ID NO: 539 - protein, 24 aa, Hepatitis C virus
MARRFPREDRSSSQGSDPWWSVAS

SEQ ID NO: 540 - protein, 18 aa, Hepatitis C virus
MSMTLSRTPLPGRGAPWK

SEQ ID NO: 541 - protein, 62 aa, Hepatitis C virus
MIFPLAHVTPRTHWNRPAELFFSSEEEGPAERPVVVRHIHGQLVVHNPELSSGPTVEDCSLA

SEQ ID NO: 542 - protein, 14 aa, Hepatitis C virus
MNQESQPLFQTPPV

SEQ ID NO: 543 - protein, 15 aa, Hepatitis C virus
MEGTHAQGGALPSRR

SEQ ID NO: 544 - protein, 14 aa, Hepatitis C virus
MEGRNGGVSPHPLQ

SEQ ID NO: 545 - protein, 12 aa, Hepatitis C virus
MDKVYWVRWCTH

SEQ ID NO: 546 - protein, 43 aa, Hepatitis C virus
MYAALQAAWTHSSHDRLLLPRKDSVSTSRRPPATRPCIPFDRK

SEQ ID NO: 547 - protein, 34 aa, Hepatitis C virus
MYRVYLGPYGHDVGCGKPHLGEQCGSRWKRWGPG

SEQ ID NO: 548 - protein, 24 aa, Hepatitis C virus
MPPRSNPRPRETYRRWNRSVWHQL

SEQ ID NO: 549 - protein, 51 aa, Hepatitis C virus
MDSAREQYILVPRKRPGPLCFYRCRSGHEGILPDSSVEQQEELNCQRKMGT

SEQ ID NO: 550 - protein, 10 aa, Hepatitis C virus
MMDKAGLLAG

SEQ ID NO: 551 - protein, 33 aa, Hepatitis C virus
MGNAKAGMDSRPCSGVSTRAPHHTGCMWPQDVS

SEQ ID NO: 552 - protein, 8 aa, Hepatitis C virus
MPGQLYKV

SEQ ID NO: 553 - protein, 9 aa, Hepatitis C virus
MLRHRPLKT

SEQ ID NO: 554 - protein, 41 aa, Hepatitis C virus
MDGSRAGTGATLPTRSPHYHRGAKGTRAEPRTGLRSDAPWG

SEQ ID NO: 555 - protein, 16 aa, Hepatitis C virus
MALPGGGGLEAARHSY

SEQ ID NO: 556 - protein, 14 aa, Hepatitis C virus
MPTPTVSRSRQSSK

SEQ ID NO: 557 - protein, 36 aa, Hepatitis C virus
MSFPPTPTVNQMDKSNWPARGSGVSLVLVRTAQLKR

SEQ ID NO: 558 - protein, 11 aa, Hepatitis C virus
MIAGKSSGVTE

SEQ ID NO: 559 - protein, 30 aa, Hepatitis C virus
MEKKCVIITMRTQMVGAYMMMLPNQELTGV

SEQ ID NO: 560 - protein, 35 aa, Hepatitis C virus
MSCSVTVESKQRVSYENPKGVFFEVHILSRRSTRC

SEQ ID NO: 561 - protein, 44 aa, Hepatitis C virus
MMVVGIGVVVSSSKSSQTERIWLMALLDKERTSFALYPNFDRAE

SEQ ID NO: 562 - protein, 21 aa, Hepatitis C virus
MVSMRAFTLDARSFTSFNTVL

SEQ ID NO: 563 - protein, 113 aa, Hepatitis C virus
MGSFSSSALHGVIRAPVQEYDIEQQTTLCSSLSLTVDQESQLKSGSPGSPSRGGMDEHDSESDSPPGEGGTLEVVLDCVSTPEEELFSSCGFKDGNDFSASARNAADTLEPSS

SEQ ID NO: 564 - protein, 20 aa, Hepatitis C virus
MLLPISCRHNKLAFTSSASG

SEQ ID NO: 565 - protein, 24 aa, Hepatitis C virus
MGKVPCHMLAHVRGPASRMDPFFT

SEQ ID NO: 566 - protein, 41 aa, Hepatitis C virus
MKGSPGSAGIILAESHDLKSDSTEQTQSQMIRSQSSLQGLG

SEQ ID NO: 567 - protein, 198 aa, Hepatitis C virus
MSLFIHCTAPSPGPTCRRSMAAHITPTTRAPGDSMAGNRLTMSSAVGSSPPMILKATKAPETPAPYPARMSSKTLPRPIPPMAAPAKPLTTNAEELWGPAKWVATHPPSMLKNIVWLVVRGLVTEAVNAIRDATAGLPGRVERPARYWIPLTKFHICLCQKASSFCQLVATMGSMTACCWVARCSNPRTFSLNWWAIA

SEQ ID NO: 568 - protein, 15 aa, Hepatitis C virus
MYGAACEHSSISSYC

SEQ ID NO: 569 - protein, 60 aa, Hepatitis C virus
MHAMTYFVMGCDKQISFWTGPNRYKRGVGPCSVGLSRTRHFHVSSQLGGGACARAHTVAW

SEQ ID NO: 570 - protein, 54 aa, Hepatitis C virus
MEKVGSRLKSTYCSTATLQSMTESKSPVYPVMRASVAQTTTSPVVGMTDTSRPL

SEQ ID NO: 571 - protein, 27 aa, Hepatitis C virus
MLECGTVMLPGGVRVAKTVSLTPAVSA

SEQ ID NO: 572 - protein, 24 aa, Hepatitis C virus
MKEPKPSVAATDGFSTRTVYPCAT

SEQ ID NO: 573 - protein, 90 aa, Hepatitis C virus
MNCRAFATPLVHTAALKIPATCPEGHITGPPEEPLRQARGLGLSKLAVESPLRRAGMTSASRVTKYKSAEPQAHGSRDLAPGGAGHPTRS

SEQ ID NO: 574 - protein, 36 aa, Hepatitis C virus
MTLISMGLNITGSVATARSLRPAAAQCCIGARWSYR

SEQ ID NO: 575 - protein, 30 aa, Hepatitis C virus
MLSMIIWKYFPPITERTSMQRRTSTCARTK

SEQ ID NO: 576 - protein, 86 aa, Hepatitis C virus
MTPSLLPRASKGGTHTWRADSHLHMVYWFHHIRRPIQCLYQGDKVKKPKRAKTPAPRVALSSPDHAYARWGSMRTSKARGQRPVRL

SEQ ID NO: 577 - protein, 19 aa, Hepatitis C virus
MRMTNSHFSAHPTMPDPTP

SEQ ID NO: 578 - protein, 78 aa, Hepatitis C virus
MFWWRCIRPVDSAGMGVKEQGSMASSVVECNSGCCSLRSRSSISQRSPLVQLQAAVNRCSNPPTNILTLNNVKLTVHG

SEQ ID NO: 579 - protein, 41 aa, Hepatitis C virus
MQRGVNQGPAPHRLYVASGCFLKQSVGQKRSDSFPEFPPPP

SEQ ID NO: 580 - protein, 44 aa, Hepatitis C virus
MSQGEAPHVLTNPVEFIHVHPNHRPPGGRRDSSRNTSVSFAPQV

SEQ ID NO: 581 - protein, 23 aa, Hepatitis C virus
MLASVKGPHPCLKKVMGLQLLSL

SEQ ID NO: 582 - protein, 44 aa, Hepatitis C virus
MNPVFMDSLQFRAVLLMCHEPLVLTSCSFCWAPTLKRLVSPLVA

SEQ ID NO: 583 - protein, 13 aa, Hepatitis C virus
MMIATLAQLPCME

SEQ ID NO: 584 - protein, 79 aa, Hepatitis C virus
MPQWAPAIMSNKVWGTRRTCATAIPRAGNQFIIISQAIRCPERWPGYSEQLQVWTVWWRRGLNVKACPTRKTAPHISPT

SEQ ID NO: 585 - protein, 19 aa, Hepatitis C virus
MTSSASYTILLLEQSLVRT

SEQ ID NO: 586 - protein, 51 aa, Hepatitis C virus
MYPMRSANPHVRVSMTLPKLRDLRRGSFGPQDGREPRGDRSHPAHPQPSLP

SEQ ID NO: 587 - protein, 58 aa, Hepatitis C virus
MVFLLVFLCGLGSVLMLHGLRDLPGHSQAPYQAVPQGLSRPNTTRLVISRGHAQISGY

SEQ ID NO: 588 - protein, 25 aa, Hepatitis C virus
MALVRVSCSLQAPPFRESHSGLRNR

SEQ ID NO: 589 - protein, 91 aa, Hepatitis C virus
MSCRVGAHNWVCAKQVRLPSDHNLADGVSLPPRHARARAGPGPSPGTLGPSTGMRAVVGQDGSCPPAVLAPAGAKMTPGVDPATWVRSSIP

SEQ ID NO: 590 - protein, 23 aa, Hepatitis C virus
MRLAYICLPTTAPTGALCMRPTT

SEQ ID NO: 591 - protein, 10 aa, Hepatitis C virus
MSQDIVWLGI

SEQ ID NO: 592 - protein, 10 aa, Hepatitis C virus
MGHGTLTALP

SEQ ID NO: 593 - protein, 19 aa, Hepatitis C virus
MVPVRTDHIAGTIHPDPVT

SEQ ID NO: 594 - protein, 30 aa, Hepatitis C virus
MSVGPSTALHPHRWWWAPLILKACQLIGLV

SEQ ID NO: 595 - protein, 19 aa, Hepatitis C virus
MMPRLPAAGPGPGLRQGVW

SEQ ID NO: 596 - protein, 37 aa, Hepatitis C virus
MNIDSQPPATGRGESAVILKIVTAVSNNHCSIQRLTR

SEQ ID NO: 597 - protein, 58 aa, Hepatitis C virus
MPPSGPGCSCSSGSLPYHHGISTGLAVLSGGTSMPYAGVRPPCKYGSPPCLFEVVGTV

SEQ ID NO: 598 - protein, 97 aa, Hepatitis C virus
MTTCPPYRTGLPRVSKDWRWPRSPSSLVLWRLRLSPGVQTQQPAETSCAGCPFRRGWAASCCWVRLTITRRWDGAYCPRSQHTPSKLGDYLELLSPA

SEQ ID NO: 599 - protein, 26 aa, Hepatitis C virus
MVLGRGLLLVTNGPRFKCTPMWTRTW

SEQ ID NO: 600 - protein, 8 aa, Hepatitis C virus
MLHRDILS

SEQ ID NO: 601 - protein, 40 aa, Hepatitis C virus
MGLTPTSVRGHAPSQPVPNSPTPHTASSSPMGVVLEAPNT

SEQ ID NO: 602 - protein, 13 aa, Hepatitis C virus
MNVTRKTLPPYWV

SEQ ID NO: 603 - protein, 8 aa, Hepatitis C virus
MAKPSHWQ

SEQ ID NO: 604 - protein, 18 aa, Hepatitis C virus
MTQVVPGMTYNLLRPQCD

SEQ ID NO: 605 - protein, 12 aa, Hepatitis C virus
MTPSCHRQNSRA

SEQ ID NO: 606 - protein, 9 aa, Hepatitis C virus
MRCGNVSYA

SEQ ID NO: 607 - protein, 44 aa, Hepatitis C virus
MMRWKNVPSLLLTSSKHRLSLSNSRTKSSACCKGRANKKLKFDP

SEQ ID NO: 608 - protein, 8 aa, Hepatitis C virus
MGLGSPAP

SEQ ID NO: 609 - protein, 16 aa, Hepatitis C virus
MYHQHTMSPRATRQQK

SEQ ID NO: 610 - protein, 46 aa, Hepatitis C virus
MTSGTGSVSYLVTLRPGFRPRSCPRCQAYPFSHVKRGTREYGEGMG

SEQ ID NO: 611 - protein, 28 aa, Hepatitis C virus
MAPSPSMNTPLGRVHPSPRTITRVPCGA

SEQ ID NO: 612 - protein, 20 aa, Hepatitis C virus
MSRCVGWGILITWWGPRTTA

SEQ ID NO: 613 - protein, 8 aa, Hepatitis C virus
MLLLVSPF

SEQ ID NO: 614 - protein, 17 aa, Hepatitis C virus
MQMGPSFHANPSRTSQC

SEQ ID NO: 615 - protein, 31 aa, Hepatitis C virus
MGRMCPRHSLPWQRDLSRRRNRKGQAHPPQE

SEQ ID NO: 616 - protein, 28 aa, Hepatitis C virus
MLTLGPPSVTPKSRAWFAVLCHTPGLAP

SEQ ID NO: 617 - protein, 10 aa, Hepatitis C virus
MTITKMYSRR

SEQ ID NO: 618 - protein, 9 aa, Hepatitis C virus
MFVPCPAKP

SEQ ID NO: 619 - protein, 62 aa, Hepatitis C virus
MTSGRRRGYTNVVTLNQRLGRQSALSQSTCTSGVPCITAKDSNAVIAAAALAASCLPALATQ

SEQ ID NO: 620 - protein, 16 aa, Hepatitis C virus
MNHSPVRNFCLHAESV

SEQ ID NO: 621 - protein, 23 aa, Hepatitis C virus
MTGSFLGTTRSMPGNLGVPPRDH

SEQ ID NO: 622 - protein, 15 aa, Hepatitis C virus
MALAPPRFSPQLGPK

SEQ ID NO: 623 - protein, 69 aa, Hepatitis C virus
MRALRRNRQQQHIVLDTDFTDGGRQAPWCDHRVDPKSCEYVGGPANAVLSTIRRRRLRGRVPCGTSVHL

SEQ ID NO: 624 - protein, 27 aa, Hepatitis C virus
MCVDEQYRVCKDLWGSPLQHLWGDEGH

SEQ ID NO: 625 - protein, 10 aa, Hepatitis C virus
MPYRLFQEAP

SEQ ID NO: 626 - protein, 159 aa, Hepatitis C virus
MLIYTYAPPVNRAHTPPPEHRGRAIPLWCWFCRSGLGSQVGVRRPRLPPSGGRTRVCGPLDDVTDFSGGSSNGELGDAERPQRSGTTGLRLVPGCILRRMAHPGEARSADNLWFDRPVAPSPARPPAPSACLRLDGRRRCHHRGRGAPAPRVLYLITMV

SEQ ID NO: 627 - protein, 9 aa, Hepatitis C virus
MGPPPACSR

SEQ ID NO: 628 - protein, 27 aa, Hepatitis C virus
MAPTVPDLSIRPANSGTIWNYCHQPDR

SEQ ID NO: 629 - protein, 43 aa, Hepatitis C virus
MSRARRYLHTGYRHGAGSSRDSRGEADGTGNRDPSRQHHGAAS

SEQ ID NO: 630 - protein, 17 aa, Hepatitis C virus
MSHTPEADSARPYSSPV

SEQ ID NO: 631 - protein, 34 aa, Hepatitis C virus
MFPVCSLHRASTGYRSAIQGQSPRLAAKGEPTRS

SEQ ID NO: 632 - protein, 56 aa, Hepatitis C virus
MAESGGVLATAHVELCERDPVPGRSLHTARQPCRGFPYGLHRLCNQPPHNQPDYVL

SEQ ID NO: 633 - protein, 72 aa, Hepatitis C virus
MCCSVAPACRPWGRSSAVDEQTHSVRISGEPCITNTLCPRERRGSKSNSIAELSNRHPIASPVTPVDQRGLS

SEQ ID NO: 634 - protein, 43 aa, Hepatitis C virus
MSKGVQGSMARGWGDDNALPLWGRLYRTRKEWVHEDSRIRPLR

SEQ ID NO: 635 - protein, 24 aa, Hepatitis C virus
MPGASARVLHRVRRSEAPPLCSSL

SEQ ID NO: 636 - protein, 38 aa, Hepatitis C virus
MRTRAGRRSVNLDVARSCSHHRRHSGPAPCARFTSIGS

SEQ ID NO: 637 - protein, 73 aa, Hepatitis C virus
MEGPNLRAARSSRVCLATNSSRTSASPPQKEDNQARWVECVRGTPCPGREIFPVDETGRDRHILLRSRYRIHR

SEQ ID NO: 638 - protein, 48 aa, Hepatitis C virus
MQRRGGKTTYQSTQQLVAETPQSCLLYVISKRRRTSEEGYLRQTASAR

SEQ ID NO: 639 - protein, 15 aa, Hepatitis C virus
MLSCPPPLRPVEVRV

SEQ ID NO: 640 - protein, 8 aa, Hepatitis C virus
MRLSPLPR

SEQ ID NO: 641 - protein, 26 aa, Hepatitis C virus
MAGSGTRHAVINVVPADTDRKPTRKI

SEQ ID NO: 642 - protein, 8 aa, Hepatitis C virus
MESFNDSW

SEQ ID NO: 643 - protein, 13 aa, Hepatitis C virus
MFGDSRVKATSVV

SEQ ID NO: 644 - protein, 20 aa, Hepatitis C virus
MLHSLFGRVLEPVGRPHRCN

SEQ ID NO: 645 - protein, 22 aa, Hepatitis C virus
MVIEHLQSVEGNLLLTCGGASR

SEQ ID NO: 646 - protein, 11 aa, Hepatitis C virus
MRPVRLTSGFQ

SEQ ID NO: 647 - protein, 27 aa, Hepatitis C virus
MQSYTEGDLVPQKGLTRRSIAVEPHSV

SEQ ID NO: 648 - protein, 51 aa, Hepatitis C virus
MSIPHPTHLDITVGGHAPQGTRVIVRGDGCTRPSGVFIDGEGAMPHVSAEA

SEQ ID NO: 649 - protein, 41 aa, Hepatitis C virus
MVPPRCERYESVHPLHCSFPRAYMPAQHCSTYHANNQRSRG

SEQ ID NO: 650 - protein, 9 aa, Hepatitis C virus
MPHDDDTTY

SEQ ID NO: 651 - protein, 12 aa, Hepatitis C virus
MSQSGKHSLPEV

SEQ ID NO: 652 - protein, 126 aa, Hepatitis C virus
MAEYKVSSSLDHCQWEGFAIKGDFSVTGEAHLLDIRMRHRDAAGRGRGCQYRQPHPGCLCLIQHRAYTQYGGSVLRVTFIADDHVIGASRTTPIGEELAVCGVGEFGTGCDGACPRTDVGVNPIGF

SEQ ID NO: 653 - protein, 44 aa, Hepatitis C virus
MVNSPHDPPYCRTQEGLGGRGQHLHLTSHHVLIPTCQAGDNSSK

SEQ ID NO: 654 - protein, 26 aa, Hepatitis C virus
MEQWLLLTAVTIFKITALSPRPVAGG

SEQ ID NO: 655 - protein, 110 aa, Hepatitis C virus
MFMSSYEHSDLEYREVHSARIMPQSVRVVYQTPWRKPGPGPAAGKRGIMVLPETIGRAFKVGLICFNVLHPPIDVARGSPTSLYKPCTVHPHTSKPPALGGSQRGQQEDI

SEQ ID NO: 656 - protein, 18 aa, Hepatitis C virus
MISDRRGGHTRVLDGHRR

SEQ ID NO: 657 - protein, 27 aa, Hepatitis C virus
MSEGSCDAPYRGADERNVPHEVGKSAR

SEQ ID NO: 658 - protein, 34 aa, Hepatitis C virus
MPRRRLRSKMKSAPSRRWAVGRLQGEQNIWSWPP

SEQ ID NO: 659 - protein, 13 aa, Hepatitis C virus
MKTLRGSSSTSTS

SEQ ID NO: 660 - protein, 20 aa, Hepatitis C virus
MLPRKRAGDPSPQMLAPSPP

SEQ ID NO: 661 - protein, 12 aa, Hepatitis C virus
MVLLWRQSRSMT

SEQ ID NO: 662 - protein, 56 aa, Hepatitis C virus
MTPRPILRQFRASHRTQRWILYLLLRRMCLSLPVSSTGKISLPGQGVPRTHSTHRA

SEQ ID NO: 663 - protein, 14 aa, Hepatitis C virus
MKGAKEGCSPVWPR

SEQ ID NO: 664 - protein, 15 aa, Hepatitis C virus
MEVNRAQGAGPLWRR

SEQ ID NO: 665 - protein, 14 aa, Hepatitis C virus
MKAGTHLHMNAILH

SEQ ID NO: 666 - protein, 51 aa, Hepatitis C virus
MGFLGRRSWPPPRNEYPPPYAPRHNCRRSRATGHASNCARGRVYSAQWCIH

SEQ ID NO: 667 - protein, 11 aa, Hepatitis C virus
MRERVCLAPWA

SEQ ID NO: 668 - protein, 27 aa, Hepatitis C virus
MLLLLLPRRSRGHSVLVIHGSPEMRTL

SEQ ID NO: 669 - protein, 16 aa, Hepatitis C virus
MLQVPLGVWLPNLQGC

SEQ ID NO: 670 - protein, 40 aa, Hepatitis C virus
MVGSPLHERRQWLDMPPSMQSLGPAVLPVTRSGHLYESVR

SEQ ID NO: 671 - protein, 39 aa, Hepatitis C virus
MLSVALWSQQVVGHTRNNLRHSTHIAPPSQTCRTAAPLE

SEQ ID NO: 672 - protein, 46 aa, Hepatitis C virus
MDLALGQNIPVQHKRRGLWCFCRFQWGREGILLGRTPGRQGGWNCH

SEQ ID NO: 673 - protein, 47 aa, Hepatitis C virus
MLRSGTVGAIPSSCNRQPDPATTRGPTAPKRATRTRCLRRLLCLHPR

SEQ ID NO: 674 - protein, 18 aa, Hepatitis C virus
MRRRMQPGTRRNPVVPLR

SEQ ID NO: 675 - protein, 49 aa, Hepatitis C virus
MSMAILASQSLNGAVVVAHCGHDLQDHSALPSSSCRRLRIDVHVLLRTF

SEQ ID NO: 676 - protein, 10 aa, Hepatitis C virus
MVCPHWDHLC

SEQ ID NO: 677 - protein, 34 aa, Hepatitis C virus
MCCCCRFRRRARIRVSARSRRRPHTQCSCWSSRW

SEQ ID NO: 678 - protein, 16 aa, Hepatitis C virus
MALPEGGGLEAARHSY

SEQ ID NO: 679 - protein, 23 aa, Hepatitis C virus
MPTPTVSRSRQSSKWRVRARDTL

SEQ ID NO: 680 - protein, 83 aa, Hepatitis C virus
MSFPPTPTVNQLERSSWPAVGNGVSLVLVRTAQLKRYRPHILAFPPWAMSLARTARARCLHARRGGIPSFLRAPATLLSSVGE

SEQ ID NO: 681 - protein, 11 aa, Hepatitis C virus
MIAGKSSGVTE

SEQ ID NO: 682 - protein, 49 aa, Hepatitis C virus
MEKKWVINTMRTQMVGANMMIFPNQELTGVWRAVSQAARAKGVSGSRVR

SEQ ID NO: 683 - protein, 47 aa, Hepatitis C virus
MASVKARRAVLSSSTPQLSDITTKSSPQTRKDGFLRPAALLAAVALM

SEQ ID NO: 684 - protein, 75 aa, Hepatitis C virus
MGPPMYSRSVRALIAFRASGSRSQHWYIPSSVLMSCSVTVESKQRVSYENPKGVFFDVHILRRCSTRCLGEYWNP

SEQ ID NO: 685 - protein, 96 aa, Hepatitis C virus
MRRAGLRPPFAGFTLNTSFFAIMVVGIGVLLSSNKSSQTERIWFMALLDKERTSFALYPYFDRPEWGGTREHASSKESRRPFTPDARSFTSLSTFL

SEQ ID NO: 686 - protein, 122 aa, Hepatitis C virus
MAPVQEYDIEQQTTLCSSESLTVDQESASRSGSPGSPSRGGMDEYDSTSDSSPVSGESPDSAVDSVPTPEEDVPVPSGFVDGKDLSARARSAADTFDPSSLIVLFLRGGGTGAGRVGGKAHP

SEQ ID NO: 687 - protein, 50 aa, Hepatitis C virus
MGKVPCHMLAQRPDPAILMDPFLTCPVKSSPQGQRVVITPSPRHTPLYPF

SEQ ID NO: 688 - protein, 38 aa, Hepatitis C virus
MPGTLGMILAESQVLKSLSTIQTQSQMSCNQSPLQGLG

SEQ ID NO: 689 - protein, 194 aa, Hepatitis C virus
MSLFIHCTAPSPGPTCRRNTAAHITPTTNAPGDKMAGRRLTMSSVVGSSPPMILKATRAPETPAPYPASTSSNTLPMPMPPTAAPAKPLTTNAEDAAGPARCVATQPPRMLKNIVWLVVRGLVTEAVKAIREATAGLPGSVERPARYWIPLTKFHMCCCQNASAFCHCDCTMGRISASCWLALCSKPRTLSLNC

SEQ ID NO: 690 - protein, 9 aa, Hepatitis C virus
MTTQPTDKQ

SEQ ID NO: 691 - protein, 17 aa, Hepatitis C virus
MQAMMYLVIGCVMQMSF

SEQ ID NO: 692 - protein, 22 aa, Hepatitis C virus
MRHFHISSQHGGLAFARAQTVA

SEQ ID NO: 693 - protein, 25 aa, Hepatitis C virus
MPDGRSPGVTNRYIPGLPRPVRPLR

SEQ ID NO: 694 - protein, 54 aa, Hepatitis C virus
MEKVGSRLKSTYCSTATLQSITVSKSPVYPVMRASVAHTTTSPDTGITDTSRPL

SEQ ID NO: 695 - protein, 20 aa, Hepatitis C virus
MLPGGVAVASTVSLTPAVSA

SEQ ID NO: 696 - protein, 13 aa, Hepatitis C virus
MVRVPVRMLGSIP

SEQ ID NO: 697 - protein, 24 aa, Hepatitis C virus
MYVPKPRVAATDGFSTRTEYPCAT

SEQ ID NO: 698 - protein, 97 aa, Hepatitis C virus
MNCRAFATPLVHTAALKIPTTCPEGHMTGPPEEPLRQDSGLVLSKLAVESPLRRAGRTSASRVTRYRSEEPHVQGSRDLVPAGAGQPTRSWSTLVYI

SEQ ID NO: 699 - protein, 60 aa, Hepatitis C virus
MTPPTVVPKKVWVAVDSTCTSPVTTFLSLPVRLVTIVPNSPRVCWAYAEIGDSRRHPIFL

SEQ ID NO: 700 - protein, 48 aa, Hepatitis C virus
MSPQAAVSAPQVITLISIGLKMTGSVATASPLRPSAAQSCMGDRWSYR

SEQ ID NO: 701 - protein, 12 aa, Hepatitis C virus
MQIRINTWARTK

SEQ ID NO: 702 - protein, 80 aa, Hepatitis C virus
MSKIREGYSRLASKITLSRLPRTSRGGTHTCKAASPLHMAYWFHQIRRPIQCLYHGDKVKNPRSRSTPAPMVASSSPVQA

SEQ ID NO: 703 - protein, 13 aa, Hepatitis C virus
MCHAAQNATRYQT

SEQ ID NO: 704 - protein, 78 aa, Hepatitis C virus
MFWWRCMSPVDRRRIGVNEHGNISESVVEWSSGCCSLRSRSSRSQRSPLVQLQAAENRCSCPPTNILTLNIEKFTVQG

SEQ ID NO: 705 - protein, 44 aa, Hepatitis C virus
MLQGGAPQVFTNPVLFIHTHPNHRPWGGLKEVNKKTSDSFTPNL

SEQ ID NO: 706 - protein, 10 aa, Hepatitis C virus
MLASVNGPHP

SEQ ID NO: 707 - protein, 17 aa, Hepatitis C virus
MGLQLDIRSGHPEELNL

SEQ ID NO: 708 - protein, 13 aa, Hepatitis C virus
MCHDPFELTNCKF

SEQ ID NO: 709 - protein, 16 aa, Hepatitis C virus
MISTMTTLAQLPCMEK

SEQ ID NO: 710 - protein, 48 aa, Hepatitis C virus
MLLLEQSLVSKYRPDAFLYSRLDAGQVKQEKRARRKIEKEQPGRFPVA

SEQ ID NO: 711 - protein, 54 aa, Hepatitis C virus
MSGMYPMRSANPHVRVSMTLPKLRDLRRGSFWPQLGREPRGGKSHPAQPQPSFP

SEQ ID NO: 712 - protein, 43 aa, Hepatitis C virus
MLHGLRDLPGHSQAPYQAVPQGLSRPNTTRLVISRGHAQISGH

SEQ ID NO: 713 - protein, 28 aa, Hepatitis C virus
MGATLHHESLPCEELLSSRRKRLAMALV

SEQ ID NO: 714 - protein, 76 aa, Hepatitis C virus
MAMRVAGGRDGSCLPVALGLAGAPQTPGVGRAIWVRSSIPLRAASPTSWGTYRSSAPLLEALPGPWRMASGFWKTA

SEQ ID NO: 715 - protein, 21 aa, Hepatitis C virus
MQQGTFLVALSLSSFWPCSLA

SEQ ID NO: 716 - protein, 40 aa, Hepatitis C virus
MSPMIALTRVLCTRRPMPSCTLRGVSLAFARVTPRGVGWR

SEQ ID NO: 717 - protein, 22 aa, Hepatitis C virus
MPAAPRLGLLVSLHQAPSRTSN

SEQ ID NO: 718 - protein, 8 aa, Hepatitis C virus
MKALTPAG

SEQ ID NO: 719 - protein, 81 aa, Hepatitis C virus
MPTEAASTNAPTAGTTLQDLVALCPQRACVARYIASLPAPWWWERPTGRARLPTAGVQMIRMSSSLTTPGHRWAIGSVVPG

SEQ ID NO: 720 - protein, 23 aa, Hepatitis C virus
MQHPWPGRTVLCPSSCSSALRGI

SEQ ID NO: 721 - protein, 8 aa, Hepatitis C virus
MPSSYSCV

SEQ ID NO: 722 - protein, 91 aa, Hepatitis C virus
MCITISPLFETGRTTACEIWPLWNQSSSPEWRPSSSRGGQIPPRAVTSSTACPSLPVGARRYCLGQPTEWSPRGGGCWRPSRRTPSRREAS

SEQ ID NO: 723 - protein, 45 aa, Hepatitis C virus
MGYAGLSTTGPERGPSHHPRVLSSRCIPMWTKTLWAGPLLKVPAH

SEQ ID NO: 724 - protein, 23 aa, Hepatitis C virus
MSFPCAGEVIAGVACFRPGPFPT

SEQ ID NO: 725 - protein, 53 aa, Hepatitis C virus
MLPPAAVRAPRSRLRTQPRATRCWCSTPLLLQRWALVLTCPRPMGLILISGPG

SEQ ID NO: 726 - protein, 62 aa, Hepatitis C virus
MPHPSWASALSLTKQRLRGRDWLCSPLLPLRAPSLCPILTSRRLLCPPPERSPFTARLSPSR

SEQ ID NO: 727 - protein, 28 aa, Hepatitis C virus
MPWPTTAVLTCLSSRPAAMLSSCRPMLS

SEQ ID NO: 728 - protein, 63 aa, Hepatitis C virus
MLSPGLNAGAGLAGGSQASIDLWHRGSAPPACSTRPSSVSAMTRAVLGMSSRPPRLQLGYERT

SEQ ID NO: 729 - protein, 18 aa, Hepatitis C virus
MPTFYPRQSRVGRTFLTW

SEQ ID NO: 730 - protein, 18 aa, Hepatitis C virus
MGQHPCYTDWALFRMKSP

SEQ ID NO: 731 - protein, 16 aa, Hepatitis C virus
MRWKSALSTYRTSSKG

SEQ ID NO: 732 - protein, 48 aa, Hepatitis C virus
MQRLSPLLSRPTGRNSRSFGRSTCGISSVGYNTWRACQRCLVTPPLLH

SEQ ID NO: 733 - protein, 9 aa, Hepatitis C virus
MARAWRELL

SEQ ID NO: 734 - protein, 25 aa, Hepatitis C virus
MFPPRTTCRRAMQPPASLPYSAASL

SEQ ID NO: 735 - protein, 8 aa, Hepatitis C virus
MTPLTPSS

SEQ ID NO: 736 - protein, 33 aa, Hepatitis C virus
MSGRSPYLQKFCGSLGDSPGPCPSGRGRTTTPR

SEQ ID NO: 737 - protein, 134 aa, Hepatitis C virus
MAARYHLHGPLLCLRLGKSVRWSSPNQPYLLPWPSLPPKVLAAPQLPALRATIRQHPLSPPLLAAPPTPTLSPILPCPPWRGSLGIRISATGHGRRSVVGPTRKMSCAAQCLIPGQAHSSPRALRKNKNCPSTH

SEQ ID NO: 738 - protein, 13 aa, Hepatitis C virus
MGQKTSVAMPERP

SEQ ID NO: 739 - protein, 66 aa, Hepatitis C virus
MIPAVLTPQSLRATSVRRRQFTNVVTWTPKPAWPSSPSLRGFMLGALLPIQGGKTAATAGAARAAY

SEQ ID NO: 740 - protein, 63 aa, Hepatitis C virus
MASAHFHSTVTLQVKSIGWPHASENLGSRPCELGDTGPGASALGFCPEEAGLPYVASTSSTGQ

SEQ ID NO: 741 - protein, 17 aa, Hepatitis C virus
MPGPAGSGFAYSCSLQG

SEQ ID NO: 742 - protein, 16 aa, Hepatitis C virus
MNHSPVRNYCLHAESV

SEQ ID NO: 743 - protein, 12 aa, Hepatitis C virus
MPGDLGVPPQDC

SEQ ID NO: 744 - protein, 10 aa, Hepatitis C virus
MAPVSPWLSA

SEQ ID NO: 745 - protein, 104 aa, Hepatitis C virus
MGYDDELVPYGSVGGSSAAPDPTSHHGHDRWCSLGSPGGHSVFLHGGELGEGPGSAAAICRRRRGNPRHRGKCRPHHGWACWSPYTRRQAEHPTDQHQRQLAHQ

SEQ ID NO: 746 - protein, 69 aa, Hepatitis C virus
MLDCLPRGRNEDHRITQGSCHPDVYQCGPRPCGLARSSRFPLIDTLYLRLLGPLPGHEARRCHSRAPAR

SEQ ID NO: 747 - protein, 49 aa, Hepatitis C virus
MHVGRPGGRHEHLGARWRRPGCSGRVLPVNRLRGHSGQDRLVREAGNYT

SEQ ID NO: 748 - protein, 77 aa, Hepatitis C virus
MDEPANSLRLPGEPCFPHALRAGERCSRPRHCHTQQPHCNPAPEATASVDKLGVYHSMLRFLAKGHLGLDMRGAERL

SEQ ID NO: 749 - protein, 65 aa, Hepatitis C virus
MPVPDPIARIFHRIGRGAPTQVCAPLQALAAGGGIIQSRTPRVPGGVAITLRARTGRSRVDVHAH

SEQ ID NO: 750 - protein, 21 aa, Hepatitis C virus
MLLQRVSRPRRRWKEGLLPYP

SEQ ID NO: 751 - protein, 22 aa, Hepatitis C virus
MPQKTWGPALASLETPGPERPR

SEQ ID NO: 752 - protein, 81 aa, Hepatitis C virus
MWQVPLQLGSKNKAQTHSNSGRWPAGLVRLVHGWLQRGRHLSQRVSCPAPLVLVLPTPARCRGRHLPPPQPMKVGVNTPAS

SEQ ID NO: 753 - protein, 25 aa, Hepatitis C virus
MICREASISTLCSHAAHGPFTASRD

SEQ ID NO: 754 - protein, 24 aa, Hepatitis C virus
MIPPPAARACKGAQTCVGAPRPIL

SEQ ID NO: 755 - protein, 20 aa, Hepatitis C virus
MEWYTPSLSTDAVASGAGLQ

SEQ ID NO: 756 - protein, 39 aa, Hepatitis C virus
MLQELPPRPRHTLQECPRGPSPVQRCRWRRQLGQHPQRQ

SEQ ID NO: 757 - protein, 20 aa, Hepatitis C virus
MKQWRGYQAALTGPPSIVSH

SEQ ID NO: 758 - protein, 18 aa, Hepatitis C virus
MRPASRRARRTSSLSGRR

SEQ ID NO: 759 - protein, 33 aa, Hepatitis C virus
MWHPWSGTRHKLLCHKHLLSTRRRQGTCRRWST

SEQ ID NO: 760 - protein, 22 aa, Hepatitis C virus
MSGNLEERASPQGLGPHWYTSG

SEQ ID NO: 761 - protein, 17 aa, Hepatitis C virus
MRWSSFRPRGRQSSIPH

SEQ ID NO: 762 - protein, 79 aa, Hepatitis C virus
MATESAPLTRQEQRRHTTRPPPCPVRMPAEATPAGAGGEATSRRGRRPLRAPTYPSDTTQSRRTRGRTQDRASRPGMLH

SEQ ID NO: 763 - protein, 23 aa, Hepatitis C virus
MWLPDVCGSNQWGRARCCCPPLR

SEQ ID NO: 764 - protein, 12 aa, Hepatitis C virus
MPCDDPLYGRDR

SEQ ID NO: 765 - protein, 16 aa, Hepatitis C virus
MALPGGGVLEAARHSY

SEQ ID NO: 766 - protein, 19 aa, Hepatitis C virus
MPTPAASRSRQNQNQRGRA

SEQ ID NO: 767 - protein, 43 aa, Hepatitis C virus
MAALPPLDRSLARTLRARCLQARKGGTPSFLRHAATLLISPGE

SEQ ID NO: 768 - protein, 11 aa, Hepatitis C virus
MIGGRSSGSME

SEQ ID NO: 769 - protein, 51 aa, Hepatitis C virus
MRTLKKWVISIILAHSVGANMIMLPSQELTGVCLAVSHAALARGVVGSRVR

SEQ ID NO: 770 - protein, 17 aa, Hepatitis C virus
MVQSWSPAARQAARALM

SEQ ID NO: 771 - protein, 13 aa, Hepatitis C virus
MATRAWGSRSQHW

SEQ ID NO: 772 - protein, 42 aa, Hepatitis C virus; identical to SEQ ID NO: 62

SEQ ID NO: 773 - protein, 12 aa, Hepatitis C virus
MRRAGLRPPFSG

SEQ ID NO: 774 - protein, 36 aa, Hepatitis C virus
MMVVSIGVTLSSRRSFHTELMWATAFLAWQRTSFAP

SEQ ID NO: 775 - protein, 19 aa, Hepatitis C virus
MGSFCSSAAHGVTSAPVQE

SEQ ID NO: 776 - protein, 54 aa, Hepatitis C virus
MPEVEELPKLLVASSAKAVDRVDSVRTTVRFFRGGGTGGDRGGGSGQPWTTGGS

SEQ ID NO: 777 - protein, 140 aa, Hepatitis C virus
MLPPISCLHRRLASMSSASGESWLAVQVALRDGADSWLAEELAIEGGDPLANLLPAASAVIWEGSVSMDVNTATSGSGSQGNCDPTGYSWSPTLNDTSSRSKGLQGGANLCRRTPSNSVKNSGDGIWHGHLRLSVVIPDT

SEQ ID NO: 778 - protein, 100 aa, Hepatitis C virus
MGNVPLHMFLQVLGPTILIVPFLTCPVISAPQWQRVCIMPSPRQTPLYPRWQDTKGIPGSCGMSLAFSQVLKSLSTSHIQSQMSLSQEPEHGVVHSELIH

SEQ ID NO: 779 - protein, 13 aa, Hepatitis C virus
MAVTRAAASLSGT

SEQ ID NO: 780 - protein, 173 aa, Hepatitis C virus
MAGSRLTRSSVEGTSPLMILNATRAPATPAPYPARMSTRTFPSPTLPMAAPARPAPTKAVAAPGAASWAATHPPNMLKRRVWPVVSGLVTAAVKAINEAMAGLPGSVDRPAKYCIPLMKFHMCFAQKTSSFCQLVWTAGVITSAWRDAVCRRPRAFCLNCSASIIPCSMYGKC

SEQ ID NO: 781 - protein, 50 aa, Hepatitis C virus
MTTQPVDRQYAARAARTPPTSTQVLVTTSRSADMHVMMYLVIGCVRVTSF

SEQ ID NO: 782 - protein, 22 aa, Hepatitis C virus
MYARSLTVVSAGVSSYQAQPAS

SEQ ID NO: 783 - protein, 12 aa, Hepatitis C virus
MPEGRSPGATNL

SEQ ID NO: 784 - protein, 12 aa, Hepatitis C virus
MPGFPLPVLPRR

SEQ ID NO: 785 - protein, 12 aa, Hepatitis C virus
MVKVGSRLKSTV

SEQ ID NO: 786 - protein, 23 aa, Hepatitis C virus
MRASVDTTTTSPLVGMTDTSRPR

SEQ ID NO: 787 - protein, 36 aa, Hepatitis C virus
MPNATSFAASSSHFFFEWQKMRCLPPLITSRGIALP

SEQ ID NO: 788 - protein, 52 aa, Hepatitis C virus
MLGWDTVTEPGGVAVASTTSLAPAVSAWSRTVPMPKMDVASVEWHSSQIIMS

SEQ ID NO: 789 - protein, 24 aa, Hepatitis C virus
MGLPVVIVLTPVLILGSTPWALDM

SEQ ID NO: 790 - protein, 45 aa, Hepatitis C virus
MVVPRFSTGIKSTALATPRVHTAALNRPTACPAGHNSGPPEEPFK

SEQ ID NO: 791 - protein, 27 aa, Hepatitis C virus
MGRGESRLPLLSPRRRTGMTSACLVTR

SEQ ID NO: 792 - protein, 16 aa, Hepatitis C virus
MTGPLGDAMVLVPAPW

SEQ ID NO: 793 - protein, 126 aa, Hepatitis C virus
MHVARKVWVAVDTIWTSPSTWFLSRPVRLVIIHPRRPLVCWAYAVMGASNLHPLETIPSAGPSSISWPLRAETGKPLMMSPHAAVSAPHVMSLVSIREKTTGSTATARSRRPLCAQSRRGVRWLYT

SEQ ID NO: 794 - protein, 48 aa, Hepatitis C virus
MARSSLVMSNTRVGCTTHMSKMTASRPPRTLRGGTHTCSCASTLVRKY

SEQ ID NO: 795 - protein, 117 aa, Hepatitis C virus
MSNIIHKQEQTRASASRRNRRTTYSHLMAQDAMLDPTPYKYCTSTMFWWRWMRPVDKAGRVVKEHGRTCHCVVDSSNGLSSDLSLSSRSQRSPRVQLQAASSLCSTPPTYILTLNMV

SEQ ID NO: 796 - protein, 81 aa, Hepatitis C virus
MHLGVIQGPEPHREYVASGCLRKQSVGQSKVLLPTPPMTQGGAPHTLVNPVEFIQVQPNQLPSGGLVLLRTKTSVSFAPQL

SEQ ID NO: 797 - protein, 70 aa, Hepatitis C virus
MCQLPLVLISWMFCLAPGVRRPTSPAVVRPAFPPVTWVSASTPANSSSTTRTFAQFPTMEKYAMPARTPQ

SEQ ID NO: 798 - protein, 11 aa, Hepatitis C virus
MSMMACGIRSS

SEQ ID NO: 799 - protein, 19 aa, Hepatitis C virus
MASAASYTILELGQSLVTW

SEQ ID NO: 800 - protein, 51 aa, Hepatitis C virus; identical to SEQ ID NO: 90

SEQ ID NO: 801 - protein, 43 aa, Hepatitis C virus; identical to SEQ ID NO: 91

SEQ ID NO: 802 - protein, 76 aa, Hepatitis C virus
MRLTDLSQLAVTRAKMEPPLKKGKRKEKKKERKEKKKEKKKKKKKKNRKWLKRPECLPQPSSVGEEVDAYPCSEQE

SEQ ID NO: 803 - protein, 93 aa, Hepatitis C virus
MRHAVINVSPAVASREPTGQVQPASGRYWSEFELCSYCPVEEVLATYGSPASSGQKPSADAPGPVSPSSQGRDPKFSEACGHPIDFTWRVTVE

SEQ ID NO: 804 - protein, 8 aa, Hepatitis C virus
MESLNDWR

SEQ ID NO: 805 - protein, 19 aa, Hepatitis C virus
MGHQYHPRPQCGGKHDYVA

SEQ ID NO: 806 - protein, 15 aa, Hepatitis C virus
MATDVFCPIAKLGFG

SEQ ID NO: 807 - protein, 12 aa, Hepatitis C virus
MWGRQAASFLYG

SEQ ID NO: 808 - protein, 21 aa, Hepatitis C virus
MAVQNLQSVKCDFLLPLASTA

SEQ ID NO: 809 - protein, 15 aa, Hepatitis C virus
MDHRWFVVRLFPRLY

SEQ ID NO: 810 - protein, 25 aa, Hepatitis C virus
MVGGASCLERWSGQLASRGAGHRRG

SEQ ID NO: 811 - protein, 20 aa, Hepatitis C virus
MGGISEHGRQHGYVRFGLAR

SEQ ID NO: 812 - protein, 61 aa, Hepatitis C virus
MSSDLSSTVAASVHNAVSSPDPPIPALAGHKGNPRQLWHELGFQPGLKVAQHLAYPVPDVP

SEQ ID NO: 813 - protein, 42 aa, Hepatitis C virus
MQSPQELGYSEAAEYGSDAGGCIALRHVVRGGNMVPPGGEGY

SEQ ID NO: 814 - protein, 27 aa, Hepatitis C virus
MAGRGLQEAEGLLLELLSEHHPLLDVR

SEQ ID NO: 815 - protein, 46 aa, Hepatitis C virus
MEGGFKADQTLPHLVPRWGRGLSPSAHGGLVRYQVRKVLPTLLCLG

SEQ ID NO: 816 - protein, 28 aa, Hepatitis C virus
MSEARKDALPKFKMVLAHGKPRGVHVRS

SEQ ID NO: 817 - protein, 84 aa, Hepatitis C virus
MSSPLDHLEGDSLAVKGDLSGGGQSNLLDVRMGHSDGARRGSSGEHNQSRPRSLCLVKDSADAQDGCGIRGVALVTNYYVISTS

SEQ ID NO: 818 - protein, 71 aa, Hepatitis C virus
MGLGHVSTKAQRCSNRGVEHQHLVALGCVRSRDLGALTAAGGSMQVGHLEALGHCWWRGVVREHRGSHGCP

SEQ ID NO: 819 - protein, 11 aa, Hepatitis C virus
MVIHIGASKRP

SEQ ID NO: 820 - protein, 8 aa, Hepatitis C virus
MTSGYLPR

SEQ ID NO: 821 - protein, 32 aa, Hepatitis C virus
MFAEAISGAEQGVVAHPSDDTRGRSAHFGESS

SEQ ID NO: 822 - protein, 126 aa, Hepatitis C virus
MTRYMAGIDRTIAVLRRPVAPGREGKQLTNKKDRPAQVPHVEGRAEGGAPDKQIDMTSKLRCGEFAVPGGHRGGHRHPTPRGVTLANARDTPRSVQDGIGRLVHNTRVRAIIGDMVKPRGIAHLVG

SEQ ID NO: 823 - protein, 10 aa, Hepatitis C virus
TLWAGPLLKV

SEQ ID NO: 824 - protein, 9 aa, Hepatitis C virus
LLLQRWALV

SEQ ID NO: 825 - protein, 9 aa, Hepatitis C virus
FMLGALLPI

SEQ ID NO: 826 - protein, 9 aa, Hepatitis C virus
RLLQLKYCV

SEQ ID NO: 827 - protein, 10 aa, Hepatitis C virus
FLYLPLSFAV

SEQ ID NO: 828 - protein, 20 aa, HCV- derived
MWNFISGIQYLAGLSTLPGN

SEQ ID NO: 829 - protein, 14 aa, HCV-derived
GYKVLVLNPSVAAT

SEQ ID NO: 830 - protein, 10 aa, Hepatitis C virus
KMLNRRVLWV

SEQ ID NO: 831 - protein, 10 aa, Hepatitis C virus
VLLMCQLPLV

SEQ ID NO: 832 - protein, 10 aa, Hepatitis C virus
MLNRRVLWVV

SEQ ID NO: 833 - protein, 10 aa, Hepatitis C virus
TILELEQSFV

SEQ ID NO: 834 - protein, 9 aa, Hepatitis C virus
KMMSPHAAV

SEQ ID NO: 835 - protein, 14 aa, Human immunodeficiency virus
MGKNSVKARGKEKI

SEQ ID NO: 836 - protein, 11 aa, Human immunodeficiency virus
MGKQGARTIRS

SEQ ID NO: 837 - protein, 3 aa, Human immunodeficiency virus
MHG

SEQ ID NO: 838 - protein, 22 aa, Human immunodeficiency virus
MRKLQNGIECIQCMQGLLHQAR

SEQ ID NO: 839 - protein, 2 aa, Human immunodeficiency virus
MG

SEQ ID NO: 840 - protein, 4 aa, Human immunodeficiency virus
MDDK

SEQ ID NO: 841 - protein, 7 aa, Human immunodeficiency virus
MDNPGIK

SEQ ID NO: 842 - protein, 9 aa, Human immunodeficiency virus
MRTQIVRLF

SEQ ID NO: 843 - protein, 9 aa, Human immunodeficiency virus
MSGSGRTRP

SEQ ID NO: 844 - protein, 12 aa, Human immunodeficiency virus
MWKGRTPNERLY

SEQ ID NO: 845 - protein, 4 aa, Human immunodeficiency virus
MIQY

SEQ ID NO: 846 - protein, 18 aa, Human immunodeficiency virus
METKNDRGNWRFYQSKTV

SEQ ID NO: 847 - protein, 5 aa, Human immunodeficiency virus
MIRYS

SEQ ID NO: 848 - protein, 9 aa, Human immunodeficiency virus
MAQKLNNGH

SEQ ID NO: 849 - protein, 29 aa, Human immunodeficiency virus
MAIDRRKNKSISRNLYRNGKGRENFKNWA

SEQ ID NO: 850 - protein, 10 aa, Human immunodeficiency virus
MEKISRFQRT

SEQ ID NO: 851 - protein, 10 aa, Human immunodeficiency virus
MWVMHIFQFP

SEQ ID NO: 852 - protein, 14 aa, Human immunodeficiency virus
MKTSGSILHLPYLV

SEQ ID NO: 853 - protein, 27 aa, Human immunodeficiency virus
MRHQGLDISTMCFHRDGKDHQQYSKVA

SEQ ID NO: 854 - protein, 4 aa, Human immunodeficiency virus
MICM

SEQ ID NO: 855 - protein, 12 aa, Human immunodeficiency virus
MNSILINGQYSL

SEQ ID NO: 856 - protein, 17 aa, Human immunodeficiency virus
MDSTAYSAARKRQLDCQ

SEQ ID NO: 857 - protein, 5 aa, Human immunodeficiency virus
MTYRS

SEQ ID NO: 858 - protein, 10 aa, Human immunodeficiency virus
MECIMTHQKT

SEQ ID NO: 859 - protein, 10 aa, Human immunodeficiency virus
MDISNLSRAI

SEQ ID NO: 860 - protein, 11 aa, Human immunodeficiency virus
MQERGVPTLMM

SEQ ID NO: 861 - protein, 5 aa, Human immunodeficiency virus
MGKDS

SEQ ID NO: 862 - protein, 15 aa, Human immunodeficiency virus
MGNMVDRVLASHLDS

SEQ ID NO: 863 - protein, 21 aa, Human immunodeficiency virus
MVPVRERTHSRSRNVLCRWGS

SEQ ID NO: 864 - protein, 9 aa, Human immunodeficiency virus
MGQLAGRLN

SEQ ID NO: 865 - protein, 12 aa, Human immunodeficiency virus
MLLIEEDKKLSP

SEQ ID NO: 866 - protein, 2 aa, Human immunodeficiency virus
MH

SEQ ID NO: 867 - protein, 11 aa, Human immunodeficiency virus
MGTSTQRNWRK

SEQ ID NO: 868 - protein, 3 aa, Human immunodeficiency virus
MNK

SEQ ID NO: 869 - protein, 2 aa, Human immunodeficiency virus
ME

SEQ ID NO: 870 - protein, 21 aa, Human immunodeficiency virus
MNMRNITVIGEQWLVILTCHL

SEQ ID NO: 871 - protein, 14 aa, Human immunodeficiency virus
MSAKRRSHAWTSRL

SEQ ID NO: 872 - protein, 3 aa, Human immunodeficiency virus
MDK

SEQ ID NO: 873 - protein, 66 aa, Human immunodeficiency virus
MATRLYTFRRKSYPGSSSCSQWIYRSRSYSSRNRAGNSILSFKISRKMASKNNTYRQWQQFHQYYG

SEQ ID NO: 874 - protein, 15 aa, Human immunodeficiency virus
MEKFSKTPYVCFRES

SEQ ID NO: 875 - protein, 21 aa, Human immunodeficiency virus
MFQGKLGDGFIDITMKALIQE

SEQ ID NO: 876 - protein, 3 aa, Human immunodeficiency virus
MVL

SEQ ID NO: 877 - protein, 4 aa, Human immunodeficiency virus
MLDW

SEQ ID NO: 878 - protein, 6 aa, Human immunodeficiency virus
MEEKEI

SEQ ID NO: 879 - protein, 9 aa, Human immunodeficiency virus
MDTRAFRGA

SEQ ID NO: 880 - protein, 14 aa, Human immunodeficiency virus
MKLLDIFLGFGSMA

SEQ ID NO: 881 - protein, 13 aa, Human immunodeficiency virus
MKLMGILGQEWKP

SEQ ID NO: 882 - protein, 3 aa, Human immunodeficiency virus
MTW

SEQ ID NO: 883 - protein, 14 aa, Human immunodeficiency virus
MGSKPKAMCKINPT

SEQ ID NO: 884 - protein, 3 aa, Human immunodeficiency virus
MRI

SEQ ID NO: 885 - protein, 16 aa, Human immunodeficiency virus
MLLIPIVVIPIVVAGK

SEQ ID NO: 886 - protein, 8 aa, Human immunodeficiency virus
MHFFINLI

SEQ ID NO: 887 - protein, 7 aa, Human immunodeficiency virus
MILPAIR

SEQ ID NO: 888 - protein, 20 aa, Human immunodeficiency virus
MEQDHVQMSAQYNVHMELGQ

SEQ ID NO: 889 - protein, 13 aa, Human immunodeficiency virus
MYKCQHSTMYTWN

SEQ ID NO: 890 - protein, 3 aa, Human immunodeficiency virus
MAV

SEQ ID NO: 891 - protein, 4 aa, Human immunodeficiency virus
MLKP

SEQ ID NO: 892 - protein, 9 aa, Human immunodeficiency virus
MECHFKTDS

SEQ ID NO: 893 - protein, 3 aa, Human immunodeficiency virus
MPL

SEQ ID NO: 894 - protein, 26 aa, Human immunodeficiency virus
MQNKTIYKHVAGSRKSNVCPSHQRTN

SEQ ID NO: 895 - protein, 19 aa, Human immunodeficiency virus
MPLPSADKLDVHQILQGCY

SEQ ID NO: 896 - protein, 15 aa, Human immunodeficiency virus
MFIKYYRAAINKRWW

SEQ ID NO: 897 - protein, 18 aa, Human immunodeficiency virus
MVVITTMGPRSSDLEEEI

SEQ ID NO: 898 - protein, 15 aa, Human immunodeficiency virus
MLVGVINLWNRFGIT

SEQ ID NO: 899 - protein, 7 aa, Human immunodeficiency virus
MNKNYWN

SEQ ID NO: 900 - protein, 8 aa, Human immunodeficiency virus
MGKFVELV

SEQ ID NO: 901 - protein, 4 aa, Human immunodeficiency virus
MPQP

SEQ ID NO: 902 - protein, 11 aa, Human immunodeficiency virus
MAYCKGKNETS

SEQ ID NO: 903 - protein, 30 aa, Human immunodeficiency virus
MGWEQHLETWKNMEQSQVAIQQLPMLLVPG

SEQ ID NO: 904 - protein, 8 aa, Human immunodeficiency virus
MVLQASTS

SEQ ID NO: 905 - protein, 10 aa, Human immunodeficiency virus
MEWMTLREKC

SEQ ID NO: 906 - protein, 6 aa, Human immunodeficiency virus
MLHISS

SEQ ID NO: 907 - protein, 11 aa, Human papillomavirus type 16
MYKTKGVTEIG

SEQ ID NO: 908 - protein, 25 aa, Human papillomavirus type 16
MSAFILTGFGSTDFGYALSFIHELL

SEQ ID NO: 909 - protein, 9 aa, Human papillomavirus type 16
MHRAANNYT

SEQ ID NO: 910 - protein, 9 aa, Human papillomavirus type 16
MYSCLQLCA

SEQ ID NO: 911 - protein, 11 aa, Human papillomavirus type 16
MCVLQATVTAT

SEQ ID NO: 912 - protein, 9 aa, Human papillomavirus type 16
MTLLFGIYA

SEQ ID NO: 913 - protein, 49 aa, Human papillomavirus type 16
MHKSRKAKSYTSRRSNCCLQYTHSNIISCIVVCSSVHNCGNFLGRSCGS

SEQ ID NO: 914 - protein, 11 aa, Human papillomavirus type 16
MGIHMLYVINV

SEQ ID NO: 915 - protein, 37 aa, Human papillomavirus type 16
MDSHLYILCINPEKQSHIPHVAVTVACSTHILILYHV

SEQ ID NO: 916 - protein, 11 aa, Human papillomavirus type 16
MSILTNFRIKL

SEQ ID NO: 917 - protein, 14 aa, Human papillomavirus type 16
MLFHTNYNNNVYTH

SEQ ID NO: 918 - protein, 26 aa, Human papillomavirus type 16
MESLLFVQMSLLFFRTQWLLTVNTPN

SEQ ID NO: 919 - protein, 11 aa, Human papillomavirus type 16
MYVLLQIIKNT

SEQ ID NO: 920 - protein, 49 aa, Human papillomavirus type 16
MITAGFLYVFLMICNKTYIDRSTDPLYYGIFAFCPDVFAFLQDTVAFDS

SEQ ID NO: 921 - protein, 11 aa, Human papillomavirus type 16
MEIHLHCMNIC

SEQ ID NO: 922 - protein, 55 aa, Human papillomavirus type 16
MQCRCISMHDYSWVSLRVLDDLQQDIHRPVHRPLILWNLCFLSRCLCFSSGHSGF

SEQ ID NO: 923 - protein, 9 aa, Human papillomavirus type 16
MTAQRRRMK

SEQ ID NO: 924 - protein, 16 aa, Human papillomavirus type 16
MVQLDKQNRTEPITIL

SEQ ID NO: 925 - protein, 19 aa, Human papillomavirus type 16
MGSVRFCLSSWTIYFILLL

SEQ ID NO: 926 - protein, 41 aa, Human papillomavirus type 16
MGHTIPSVPINRSSKVRMSTCVLCTHNRSVESHLQQKVTIL

SEQ ID NO: 927 - protein, 35 aa, Human papillomavirus type 16
MVSENRWGTQFLVCPLTGLPKYECLRVCFVRTTEA

SEQ ID NO: 928 - protein, 13 aa, Human papillomavirus type 16
MGKRVRDVMDGFM

SEQ ID NO: 929 - protein, 18 aa, Human papillomavirus type 16
MVLCRGCSGKKNRGCYIR

SEQ ID NO: 930 - protein, 18 aa, Human papillomavirus type 16
MLYQMTRTKMTVIQVKIW

SEQ ID NO: 931 - protein, 18 aa, Human papillomavirus type 16
MRCLLHRKQNNIEMQYRF

SEQ ID NO: 932 - protein, 20 aa, Human papillomavirus type 16
MLFCFLCSKQRMCCLCFCLC

SEQ ID NO: 933 - protein, 13 aa, Human papillomavirus type 16
MAILKWKLSRCYR

SEQ ID NO: 934 - protein, 255 aa, Human papillomavirus type 16
MLQVEGRHETETPCSQYSGGSGGGCSQYSSGSGGEGVSERHTICQTPLTNILNVLKTSNAKAAMLAKFKELYGVSFSELVRPFKSNKSTCCDWCIAAFGLTPSIADSIKTLLQQYCLYLHIQSLACSWGMVVLLLVRYKCGKNRETIEKLLSKLLCVSPMCMMIEPPKLRSTAAALYWYKTGISNISEVYGDTPEWIQRQTVLQHSFNDCTFELSQMVQWAYDNDIVDDSEIAYKYAQLADTNSNASAFLKSNSQ

SEQ ID NO: 935 - protein, 44 aa, Human papillomavirus type 16
MRLKHHVVSIVVEVGVVAVSTVVEVGERVLVKDTLYAKHHLQIF

SEQ ID NO: 936 - protein, 44 aa, Human papillomavirus type 16
MVFQSHGALLPVTSAEFPLQYCHTRCLRFQIISFLQLYFVFLYI

SEQ ID NO: 937 - protein, 14 aa, Human papillomavirus type 16
MPNTTYKYFKCTKN

SEQ ID NO: 938 - protein, 14 aa, Human papillomavirus type 16
MVLLILKNSPRITL

SEQ ID NO: 939 - protein, 14 aa, Human papillomavirus type 16
MQQYTNRNTLIYYF

SEQ ID NO: 940 - protein, 94 aa, Human papillomavirus type 16
MCKYKQYCCNSVFILSAILGVSPNAAIHQSQHVDLLLLNGLTNSEKLTPYNSLNFANIAAFALLVFSTFKIFVSGVWHIVCLSLTPSPPLPLLY

SEQ ID NO: 941 - protein, 13 aa, Human papillomavirus type 16
MFMGNGCVTISKI

SEQ ID NO: 942 - protein, 27 aa, Human papillomavirus type 16
MNMLNFECVNINNIVVIVFLYCQLYWV

SEQ ID NO: 943 - protein, 15 aa, Human papillomavirus type 16
MCVSNVYDDRASKIA

SEQ ID NO: 944 - protein, 23 aa, Human papillomavirus type 16
MLLLYYAILEALSSYTLETHIIV

SEQ ID NO: 945 - protein, 36 aa, Human papillomavirus type 16
METRQNGYKDKQYYNIVLMIVHLNYHRWYNGPTIMT

SEQ ID NO: 946 - protein, 10 aa, Human papillomavirus type 16
MDTKTNSITT

SEQ ID NO: 947 - protein, 26 aa, Human papillomavirus type 16
MQFHYRLLCHYRRPIVPSVIIQMYNH

SEQ ID NO: 948 - protein, 14 aa, Human papillomavirus type 16
MHNWQTLIVMQVPF

SEQ ID NO: 949 - protein, 14 aa, Human papillomavirus type 16
MSTHCCTILYNFCL

SEQ ID NO: 950 - protein, 12 aa, Human papillomavirus type 16
MMEVIGSKLLCF

SEQ ID NO: 951 - protein, 24 aa, Human papillomavirus type 16
MQFFLGMPCKNLFNAVKNDINSTP

SEQ ID NO: 952 - protein, 12 aa, Human papillomavirus type 16
MVQLTQVNHYLV

SEQ ID NO: 953 - protein, 17 aa, Human papillomavirus type 16
MAFRIYKTYYRPLQKFH

SEQ ID NO: 954 - protein, 8 aa, Human papillomavirus type 16
MVVTKNGF

SEQ ID NO: 955 - protein, 10 aa, Human papillomavirus type 16
MMLQCPVGTT

SEQ ID NO: 956 - protein, 15 aa, Human papillomavirus type 16
MHFLNCHLCSSNRAL

SEQ ID NO: 957 - protein, 8 aa, Human papillomavirus type 16
MPSIINYI

SEQ ID NO: 958 - protein, 15 aa, Human papillomavirus type 16
MEGILVVPMVYALHP

SEQ ID NO: 959 - protein, 37 aa, Human papillomavirus type 16
MLDVINNGGHFSCTNGLCFTSIETKFPSNAFLKLSSM

SEQ ID NO: 960 - protein, 51 aa, Human papillomavirus type 16
MLVQILGGLIYIIDWWCLHFLMSFHLTKTEIQCMSLMIRTGNPFSQGRGPD

SEQ ID NO: 961 - protein, 11 aa, Human papillomavirus type 16
MKMIVQTYVTI

SEQ ID NO: 962 - protein, 12 aa, Human papillomavirus type 16
MCYLLQGQRNGI

SEQ ID NO: 963 - protein, 15 aa, Human papillomavirus type 16
MFKSHFSGLVINSTF

SEQ ID NO: 964 - protein, 14 aa, Human papillomavirus type 16
MKSGHYKTLALKCI

SEQ ID NO: 965 - protein, 39 aa, Human papillomavirus type 16
MSTFHYYIVSYILFLTLVAVQLLVMLYSLIQPVLAPLGG

SEQ ID NO: 966 - protein, 13 aa, Human papillomavirus type 16
MYKKTWIYSGSAV

SEQ ID NO: 967 - protein, 32 aa, Human papillomavirus type 16
MDIQWKCSLMETYAIQCIIQTGHIYIFVKKHQ

SEQ ID NO: 968 - protein, 15 aa, Human papillomavirus type 16
MQYNALYKLDTYIYL

SEQ ID NO: 969 - protein, 81 aa, Human papillomavirus type 16
MSPSNCTSTVYPCFFIHPVGAVKYTSRLTSCNVHFSLLYCELYIVSNVSCSSIACNALFFDTASVGTTWWLICLNPISLAL

SEQ ID NO: 970 - protein, 33 aa, Human papillomavirus type 16
MCPVCIMHCIAYVSIKLHFHCISMFFYTSCWCS

SEQ ID NO: 971 - protein, 37 aa, Human papillomavirus type 16
MVYIMFMKEYEHILCSLKMMQKNIVKIKYGKFMRVVR

SEQ ID NO: 972 - protein, 69 aa, Human papillomavirus type 16
MFVFLHEHNINHNSQLDPLPQLLMLLHKYIYVSSLYNALYCICLHQTALPLYIHVFLYILLVQLNTLQG

SEQ ID NO: 973 - protein, 17 aa, Human papillomavirus type 16
MGSSCGWSGNIMSYICV

SEQ ID NO: 974 - protein, 30 aa, Human papillomavirus type 16
MNFPYFIFTIFFCIIFKLHKICSYSFMNII

SEQ ID NO: 975 - protein, 29 aa, Human papillomavirus type 16
MGRGGVVGQVLPNNFRRGYFVAAKHRCRT

SEQ ID NO: 976 - protein, 97 aa, Human papillomavirus type 16
MGVVLLLQLIRPLCELLNAVRIGALSTESLCNNLVVWQGFPVSGSDLGRWIVVCVSSVPKATALVWVAAGWLAKCCLIISGEDTSLLLNTDVGHNIT

SEQ ID NO: 977 - protein, 16 aa, Human papillomavirus type 16
MYYGCSVTITVNPSFV

SEQ ID NO: 978 - protein, 32 aa, Human papillomavirus type 16
MIVNGNVTNFCLKLKYQKLLQCLLDLCLYDKS

SEQ ID NO: 979 - protein, 27 aa, Human papillomavirus type 16
MTNLDTASTTLLACFLLCFVCFCVSAY

SEQ ID NO: 980 - protein, 74 aa, Human papillomavirus type 16
MLWMQYQDLSYRHKSSRHCNSFWYFNLRQKLVTLPFTIICKCNNCTFMFYIMSCPMPCRRHCSIQCTMLFKSIS

SEQ ID NO: 981 - protein, 33 aa, Human papillomavirus type 16
MHVLCVLQNVCVALLSNNSLLKNKQTNKKKNYI

SEQ ID NO: 982 - protein, 9 aa, Human papillomavirus type 16
MQTGRYMST

SEQ ID NO: 983 - protein, 12 aa, Human papillomavirus type 16
MYLPVCMFYKVG

SEQ ID NO: 984 - protein, 10 aa, Human papillomavirus type 16
MEVWVYFLVG

SEQ ID NO: 985 - protein, 34 aa, Human papillomavirus type 16
MEYTQCVRLYPTLFQFLTHQKIHPYFHIVIFVQQ

SEQ ID NO: 986 - protein, 30 aa, Human papillomavirus type 16
MLVHQHLYLPFPQMYQDLVLLLQLIPHLLY

SEQ ID NO: 987 - protein, 107 aa, Human papillomavirus type 16
MEGTDVGAPASIKLVSSTKETIEGSEGPTGSTVKGGLTGASVSVAVGGLVPNGIYPVRPPVPDPVPIPNPPKNTPILPYCNICSAIVLPSTLGIMSGGHVPACLHVL

SEQ ID NO: 988 - protein, 34 aa, Human papillomavirus type 16
MPSSFCRCWRLQYRWVSESGIIMCSNSSNSIINI

SEQ ID NO: 989 - protein, 17 aa, Human papillomavirus type 16
MKKFLWIHLLLAQTLTQ

SEQ ID NO: 990 - protein, 8 aa, Human papillomavirus type 16
MIILHMKV

SEQ ID NO: 991 - protein, 16 aa, Human papillomavirus type 16
MWIIHYIFLVMIIVLI

SEQ ID NO: 992 - protein, 15 aa, Human papillomavirus type 16
MYYPHLYLHMQDYHM

SEQ ID NO: 993 - protein, 18 aa, Human papillomavirus type 16
MLAYVKQLYPKSQDLELY

SEQ ID NO: 994 - protein, 108 aa, Human papillomavirus type 16
MPVRLEVNAGLCKATISKKSGSGAILILLSLLEKYNVLSTSIPSYAGLSYVISLVGVVTKAGSTTLTCCVVRLYNPRRATGRDPGMGVLLVTVLGFVLTINVSIGISS

SEQ ID NO: 995 - protein, 13 aa, Human papillomavirus type 16
MYLSTYRFSTTST

SEQ ID NO: 996 - protein, 56 aa, Human papillomavirus type 16
MQPHLLLLIMDYMIFMQMTLLQILLQPRYHLYPLHLYQVIFLQIQQFLLVVHTIFL

SEQ ID NO: 997 - protein, 18 aa, Human papillomavirus type 16
MHHQKELLYLQEYNLIKM

SEQ ID NO: 998 - protein, 25 aa, Human papillomavirus type 16
MGISGPDTKGILYAPPKGIVVFAGI

SEQ ID NO: 999 - protein, 8 aa, Human papillomavirus type 16
MKELGQLY

SEQ ID NO: 1000 - protein, 36 aa, Human papillomavirus type 16
MNMLHAQTYIIMQEHPDYLQLDIPIFLLKNLTITKY

SEQ ID NO: 1001 - protein, 21 aa, Human papillomavirus type 16
MFVRATYSSVLTTLDTGTGGK

SEQ ID NO: 1002 - protein, 53 aa, Human papillomavirus type 16
MIIYVCACNIFIRAYNLRYWDRRQVDSGLTRQPKRHLKKNMVNVYVVFVTCNN

SEQ ID NO: 1003 - protein, 20 aa, Human papillomavirus type 16
MFLHDNICLCVQHIHPCLQP

SEQ ID NO: 1004 - protein, 8 aa, Human papillomavirus type 16
MYSKYPVL

SEQ ID NO: 1005 - protein, 39 aa, Human papillomavirus type 16
MADHDLPQHLHRPKPAAVYLDYKMRCQENQTYWGQVNVF

SEQ ID NO: 1006 - protein, 31 aa, Human papillomavirus type 16
MTQKMLVLMQQMQVWIIENVYLWITNKHNCV

SEQ ID NO: 1007 - protein, 38 aa, Human papillomavirus type 16
MYIYGLQTNTIVFNWLQTTYRGTLGQRIPMYQCCSKSR

SEQ ID NO: 1008 - protein, 23 aa, Human papillomavirus type 16
MVDNHLDLLQHWYMGILCPSVPL

SEQ ID NO: 1009 - protein, 89 aa, Human papillomavirus type 16
MVIWFILALVLWTLLHYRLTKVKFHWIFVHLFANIQIILKWCQNHMATAYFFIYEGNKCLLDIYLIGLVLLVKMYQTIYTLKALGLLQI

SEQ ID NO: 1010 - protein, 12 aa, Human papillomavirus type 16
MNHITILNNCVY

SEQ ID NO: 1011 - protein, 11 aa, Human papillomavirus type 16
MYKYPVELHFC

SEQ ID NO: 1012 - protein, 9 aa, Human papillomavirus type 16
MSNKHLFPS

SEQ ID NO: 1013 - protein, 28 aa, Human papillomavirus type 16
MYKSSGTFSPTVPALLNKCLTNICSLRK

SEQ ID NO: 1014 - protein, 78 aa, Human papillomavirus type 16
MPKYSINLIGYNEHRATIMAFVGVTNYLLLLLILHAVQICHYVLPYLLQKLHIKILTLRSTYDMGRNMIYSLFFNCAK

SEQ ID NO: 1015 - protein, 11 aa, Human papillomavirus type 16
MCCHIYFRNYI

SEQ ID NO: 1016 - protein, 37 aa, Human papillomavirus type 16
MAAHNDIFVLRVVSTTVTNSWLPQQMPLLWPCARCNQ

SEQ ID NO: 1017 - protein, 14 aa, Human papillomavirus type 16
MYVITSAVKVILHS

SEQ ID NO: 1018 - protein, 9 aa, Human papillomavirus type 16
MYVCHNVCS

SEQ ID NO: 1019 - protein, 16 aa, Human papillomavirus type 16
MFLTSNCLGYKPISIF

SEQ ID NO: 1020 - protein, 11 aa, Human papillomavirus type 16
MIPLKNTLFGK

SEQ ID NO: 1021 - protein, 20 aa, Human papillomavirus type 16
MYVELVLFVVYMFVCACMCL

SEQ ID NO: 1022 - protein, 27 aa, Human papillomavirus type 16
MCLYVLVNIKLYVCLYVWYNKHVCMCF

SEQ ID NO: 1023 - protein, 28 aa, Human papillomavirus type 16
MCVCMYGIINTCVCVFKCLCNYCVMQHK

SEQ ID NO: 1024 - protein, 29 aa, Human papillomavirus type 16
MLHDTIVTQAFKNTYTRVYYTIHTNTHTT

SEQ ID NO: 1025 - protein, 10 aa, Human papillomavirus type 16
MNNHNTISRC

SEQ ID NO: 1026 - protein, 24 aa, Human papillomavirus type 16
MGLALQNIVYIKQKQDVANIVYIQ

SEQ ID NO: 1027 - protein, 19 aa, Human papillomavirus type 16
MLFGTKCVFLNSSMSATMV

SEQ ID NO: 1028 - protein, 17 aa, Human papillomavirus type 16
MQPNSVEATKWAWRYKI

SEQ ID NO: 1029 - protein, 8 aa, Human papillomavirus type 16
MRAKSLFS

SEQ ID NO: 1030 - protein, 26 aa, Human papillomavirus type 16
MVGKQCRSGKQGFGTHGKQETYKFKP

SEQ ID NO: 1031 - protein, 30 aa, Human papillomavirus type 16
MEWLASSAGQENRDLARMASRKRTSLNHSC

SEQ ID NO: 1032 - protein, 36 aa, Human papillomavirus type 16
MYIVSYKINHYAPTPYIPLLGTYFWLVLTNLIAYLA

SEQ ID NO: 1033 - protein, 9 aa, Human papillomavirus type 16
MRQRLTYRC

SEQ ID NO: 1034 - protein, 22 aa, Human papillomavirus type 16
MCLTAVCKALAHSDLFYMTQCT

SEQ ID NO: 1035 - protein, 33 aa, Human papillomavirus type 16
MNCVKVSHTLFICKTAHGCVQTDFGLHIYKQLI

SEQ ID NO: 1036 - protein, 18 aa, Human papillomavirus type 16
MCSFTNEQCMTNLYTVHV

SEQ ID NO: 1037 - protein, 20 aa, Human papillomavirus type 16
MCNPKSVCTHPCAVLQMNNV

SEQ ID NO: 1038 - protein, 9 aa, Influenza virus
GLCTLVAML

SEQ ID NO: 1039 - protein, 10 aa, Influenza virus
IASNENMETM

SEQ ID NO: 1040 - protein, 9 aa, Influenza virus
TMLYNKMEF

SEQ ID NO: 1041 - protein, 9 aa, Influenza virus
SSIAAQDAL

SEQ ID NO: 1042 - protein, 9 aa, Influenza virus
VTILNLALL

SEQ ID NO: 1043 - protein, 26 aa, ODN1a
ICICICICICICICICICICICICIC

SEQ ID NO: 1044 - protein, 11 aa, KLK
KLKLLLLLKLK

SEQ ID NO: 1045 - protein, 9 aa, Human papillomavirus type 16
IVCPICSQK

SEQ ID NO: 1046 - protein, 8 aa, Human papillomavirus type 16
LQKGDYLK

SEQ ID NO: 1047 - protein, 8 aa, Human papillomavirus type 16
MAILKWKL

SEQ ID NO: 1048 - protein, 9 aa, Human papillomavirus type 16
KAKTAGMAI

SEQ ID NO: 1049 - protein, 9 aa, Human papillomavirus type 16
GMAILKWKL

SEQ ID NO: 1050 - protein, 10 aa, Human papillomavirus type 16
DYLKAKTAGM

SEQ ID NO: 1051 - protein, 10 aa, Human papillomavirus type 16
KTAGMAILKW

SEQ ID NO: 1052 - protein, 10 aa, Human papillomavirus type 16
ILKWKLSRCY

SEQ ID NO: 1053 - protein, 8 aa, Human papillomavirus type 16
TLYAKHHL

SEQ ID NO: 1054 - protein, 8 aa, Human papillomavirus type 16
YAKHHLQI

SEQ ID NO: 1055 - protein, 9 aa, Human papillomavirus type 16
VGVVAVSTV

SEQ ID NO: 1056 - protein, 9 aa, Human papillomavirus type 16
VAVSTVVEV

SEQ ID NO: 1057 - protein, 9 aa, Human papillomavirus type 16
STVVEVGER

SEQ ID NO: 1058 - protein, 9 aa, Human papillomavirus type 16
EVGERVLVK

SEQ ID NO: 1059 - protein, 9 aa, Human papillomavirus type 16
ERVLVKDTL

SEQ ID NO: 1060 - protein, 9 aa, Human papillomavirus type 16
LVKDTLYAK

SEQ ID NO: 1061 - protein, 10 aa, Human papillomavirus type 16
VGVVAVSTVV

SEQ ID NO: 1062 - protein, 10 aa, Human papillomavirus type 16
GERVLVKDTL

SEQ ID NO: 1063 - protein, 10 aa, Human papillomavirus type 16
ERVLVKDTLY

SEQ ID NO: 1064 - protein, 10 aa, Human papillomavirus type 16
VLVKDTLYAK

SEQ ID NO: 1065 - protein, 10 aa, Human papillomavirus type 16
LYAKHHLQIF

SEQ ID NO: 1066 - protein, 8 aa, Human papillomavirus type 16
LHLDLHPV

SEQ ID NO: 1067 - protein, 8 aa, Human papillomavirus type 16
IRTGNPFS

SEQ ID NO: 1068 - protein, 9 aa, Human papillomavirus type 16
VQILGGLIY

SEQ ID NO: 1069 - protein, 9 aa, Human papillomavirus type 16
LIYIIDWWC

SEQ ID NO: 1070 - protein, 9 aa, Human papillomavirus type 16
IYIIDWWCL

SEQ ID NO: 1071 - protein, 9 aa, Human papillomavirus type 16
IDWWCLHFL

SEQ ID NO: 1072 - protein, 9 aa, Human papillomavirus type 16
LHFLMSFHL

SEQ ID NO: 1073 - protein, 9 aa, Human papillomavirus type 16
FLMSFHLTK

SEQ ID NO: 1074 - protein, 9 aa, Human papillomavirus type 16
IQCMSLMIR

SEQ ID NO: 1075 - protein, 10 aa, Human papillomavirus type 16
GLIYIIDWWC

SEQ ID NO: 1076 - protein, 10 aa, Human papillomavirus type 16
LIYIIDWWCL

SEQ ID NO: 1077 - protein, 10 aa, Human papillomavirus type 16
CLHFLMSFHL

SEQ ID NO: 1078 - protein, 10 aa, Human papillomavirus type 16
FLMSFHLTKT

SEQ ID NO: 1079 - protein, 10 aa, Human papillomavirus type 16
RTGNPFSQGR

SEQ ID NO: 1080 - protein, 8 aa, Human papillomavirus type 16
KALQAIEL

SEQ ID NO: 1081 - protein, 8 aa, Human papillomavirus type 16
LQAIELQL

SEQ ID NO: 1082 - protein, 8 aa, Human papillomavirus type 16
VQFDGDIC

SEQ ID NO: 1083 - protein, 8 aa, Human papillomavirus type 16
GQVDYYGL

SEQ ID NO: 1084 - protein, 8 aa, Human papillomavirus type 16
EGIRTYFV

SEQ ID NO: 1085 - protein, 8 aa, Human papillomavirus type 16
IRTYFVQF

SEQ ID NO: 1086 - protein, 8 aa, Human papillomavirus type 16
RTYFVQFK

SEQ ID NO: 1087 - protein, 8 aa, Human papillomavirus type 16
IRQHLANH

SEQ ID NO: 1088 - protein, 8 aa, Human papillomavirus type 16
AATHTKAV

SEQ ID NO: 1089 - protein, 8 aa, Human papillomavirus type 16
THTKAVAL

SEQ ID NO: 1090 - protein, 8 aa, Human papillomavirus type 16
NPCHTTKL

SEQ ID NO: 1091 - protein, 8 aa, Human papillomavirus type 16
HRDSVDSA

SEQ ID NO: 1092 - protein, 8 aa, Human papillomavirus type 16
GRINCNSN

SEQ ID NO: 1093 - protein, 8 aa, Human papillomavirus type 16
LRYRFKKH

SEQ ID NO: 1094 - protein, 8 aa, Human papillomavirus type 16
YRFKKHCT

SEQ ID NO: 1095 - protein, 8 aa, Human papillomavirus type 16
DQFLSQVK

SEQ ID NO: 1096 - protein, 9 aa, Human papillomavirus type 16
LAVSKNKAL

SEQ ID NO: 1097 - protein, 9 aa, Human papillomavirus type 16
QAIELQLTL

SEQ ID NO: 1098 - protein, 9 aa, Human papillomavirus type 16
LQLTLETIY

SEQ ID NO: 1099 - protein, 9 aa, Human papillomavirus type 16
QYSNEKWTL

SEQ ID NO: 1100 - protein, 9 aa, Human papillomavirus type 16
TLQDVSLEV

SEQ ID NO: 1101 - protein, 9 aa, Human papillomavirus type 16
LQDVSLEVY

SEQ ID NO: 1102 - protein, 9 aa, Human papillomavirus type 16
VQFDGDICN

SEQ ID NO: 1103 - protein, 9 aa, Human papillomavirus type 16
GQVDYYGLY

SEQ ID NO: 1104 - protein, 9 aa, Human papillomavirus type 16
QVDYYGLYY

SEQ ID NO: 1105 - protein, 9 aa, Human papillomavirus type 16
VHEGIRTYF

SEQ ID NO: 1106 - protein, 9 aa, Human papillomavirus type 16
IRTYFVQFK

SEQ ID NO: 1107 - protein, 9 aa, Human papillomavirus type 16
VQFKDDAEK

SEQ ID NO: 1108 - protein, 9 aa, Human papillomavirus type 16
EVSSPEIIR

SEQ ID NO: 1109 - protein, 9 aa, Human papillomavirus type 16
QRPRSEPDT

SEQ ID NO: 1110 - protein, 9 aa, Human papillomavirus type 16
NPCHTTKLL

SEQ ID NO: 1111 - protein, 9 aa, Human papillomavirus type 16
GRINCNSNT

SEQ ID NO: 1112 - protein, 9 aa, Human papillomavirus type 16
NTLKCLRYR

SEQ ID NO: 1113 - protein, 9 aa, Human papillomavirus type 16
TLKCLRYRF

SEQ ID NO: 1114 - protein, 9 aa, Human papillomavirus type 16
LRYRFKKHC

SEQ ID NO: 1115 - protein, 9 aa, Human papillomavirus type 16
YRFKKHCTL

SEQ ID NO: 1116 - protein, 9 aa, Human papillomavirus type 16
SEWQRDQFL

SEQ ID NO: 1117 - protein, 9 aa, Human papillomavirus type 16
QRDQFLSQV

SEQ ID NO: 1118 - protein, 9 aa, Human papillomavirus type 16
KTITVSTGF

SEQ ID NO: 1119 - protein, 10 aa, Human papillomavirus type 16
KALQAIELQL

SEQ ID NO: 1120 - protein, 10 aa, Human papillomavirus type 16
LQAIELQLTL

SEQ ID NO: 1121 - protein, 10 aa, Human papillomavirus type 16
SQYSNEKWTL

SEQ ID NO: 1122 - protein, 10 aa, Human papillomavirus type 16
LQDVSLEVYL

SEQ ID NO: 1123 - protein, 10 aa, Human papillomavirus type 16
VQFDGDICNT

SEQ ID NO: 1124 - protein, 10 aa, Human papillomavirus type 16
QFDGDICNTM

SEQ ID NO: 1125 - protein, 10 aa, Human papillomavirus type 16
YICEEASVTV

SEQ ID NO: 1126 - protein, 10 aa, Human papillomavirus type 16
VEGQVDYYGL

SEQ ID NO: 1127 - protein, 10 aa, Human papillomavirus type 16
GQVDYYGLYY

SEQ ID NO: 1128 - protein, 10 aa, Human papillomavirus type 16
YGLYYVHEGI

SEQ ID NO: 1129 - protein, 10 aa, Human papillomavirus type 16
FVQFKDDAEK

SEQ ID NO: 1130 - protein, 10 aa, Human papillomavirus type 16
VQFKDDAEKY

SEQ ID NO: 1131 - protein, 10 aa, Human papillomavirus type 16
DAEKYSKNKV

SEQ ID NO: 1132 - protein, 10 aa, Human papillomavirus type 16
IRQHLANHPA

SEQ ID NO: 1133 - protein, 10 aa, Human papillomavirus type 16
HPAATHTKAV

SEQ ID NO: 1134 - protein, 10 aa, Human papillomavirus type 16
LGTEETQTTI

SEQ ID NO: 1135 - protein, 10 aa, Human papillomavirus type 16
ETQTTIQRPR

SEQ ID NO: 1136 - protein, 10 aa, Human papillomavirus type 16
DTGNPCHTTK

SEQ ID NO: 1137 - protein, 10 aa, Human papillomavirus type 16
HRDSVDSAPI

SEQ ID NO: 1138 - protein, 10 aa, Human papillomavirus type 16
GRINCNSNTT

SEQ ID NO: 1139 - protein, 10 aa, Human papillomavirus type 16
VHLKGDANTL

SEQ ID NO: 1140 - protein, 10 aa, Human papillomavirus type 16
NTLKCLRYRF

SEQ ID NO: 1141 - protein, 10 aa, Human papillomavirus type 16
LRYRFKKHCT

SEQ ID NO: 1142 - protein, 10 aa, Human papillomavirus type 16
RYRFKKHCTL

SEQ ID NO: 1143 - protein, 10 aa, Human papillomavirus type 16
YRFKKHCTLY

SEQ ID NO: 1144 - protein, 10 aa, Human papillomavirus type 16
QRDQFLSQVK

SEQ ID NO: 1145 - protein, 8 aa, Human papillomavirus type 16
WRAFCFAL

SEQ ID NO: 1146 - protein, 8 aa, Human papillomavirus type 16
CAFVCLPI

SEQ ID NO: 1147 - protein, 8 aa, Human papillomavirus type 16
AAFVCVYI

SEQ ID NO: 1148 - protein, 9 aa, Human papillomavirus type 16
WRAFCFALC

SEQ ID NO: 1149 - protein, 9 aa, Human papillomavirus type 16
AFCFALCAF

SEQ ID NO: 1150 - protein, 9 aa, Human papillomavirus type 16
FALCAFVCL

SEQ ID NO: 1151 - protein, 9 aa, Human papillomavirus type 16
SAAFVCVYI

SEQ ID NO: 1152 - protein, 9 aa, Human papillomavirus type 16
VYIHIINNI

SEQ ID NO: 1153 - protein, 10 aa, Human papillomavirus type 16
HYWRAFCFAL

SEQ ID NO: 1154 - protein, 10 aa, Human papillomavirus type 16
WRAFCFALCA

SEQ ID NO: 1155 - protein, 10 aa, Human papillomavirus type 16
CFALCAFVCL

SEQ ID NO: 1156 - protein, 10 aa, Human papillomavirus type 16
LPINTSAAFV

SEQ ID NO: 1157 - protein, 10 aa, Human papillomavirus type 16
AAFVCVYIHI

SEQ ID NO: 1158 - protein, 9 aa, Human papillomavirus type 16
TQTFCKTHK

SEQ ID NO: 1159 - protein, 9 aa, Human papillomavirus type 16
CLLSQYLRL

SEQ ID NO: 1160 - protein, 10 aa, Human papillomavirus type 16
TCLLSQYLRL

SEQ ID NO: 1161 - protein, 8 aa, Human papillomavirus type 16
TPISLVFL

SEQ ID NO: 1162 - protein, 8 aa, Human papillomavirus type 16
TPHFIIQI

SEQ ID NO: 1163 - protein, 8 aa, Human papillomavirus type 16
IQIHSGWF

SEQ ID NO: 1164 - protein, 10 aa, Human papillomavirus type 16
FLTPHFIIQI

SEQ ID NO: 1165 - protein, 8 aa, Human papillomavirus type 16
LALVLWTL

SEQ ID NO: 1166 - protein, 8 aa, Human papillomavirus type 16
YRLTKVKF

SEQ ID NO: 1167 - protein, 8 aa, Human papillomavirus type 16
FHWIFVHL

SEQ ID NO: 1168 - protein, 8 aa, Human papillomavirus type 16
FANIQIIL

SEQ ID NO: 1169 - protein, 8 aa, Human papillomavirus type 16
MATAYFFI

SEQ ID NO: 1170 - protein, 8 aa, Human papillomavirus type 16
YQTIYTLK

SEQ ID NO: 1171 - protein, 8 aa, Human papillomavirus type 16
KALGLLQI

SEQ ID NO: 1172 - protein, 9 aa, Human papillomavirus type 16
LALVLWTLL

SEQ ID NO: 1173 - protein, 9 aa, Human papillomavirus type 16
TLLHYRLTK

SEQ ID NO: 1174 - protein, 9 aa, Human papillomavirus type 16
LLHYRLTKV

SEQ ID NO: 1175 - protein, 9 aa, Human papillomavirus type 16
HYRLTKVKF

SEQ ID NO: 1176 - protein, 9 aa, Human papillomavirus type 16
KFHWIFVHL

SEQ ID NO: 1177 - protein, 9 aa, Human papillomavirus type 16
LFANIQIIL

SEQ ID NO: 1178 - protein, 9 aa, Human papillomavirus type 16
CQNHMATAY

SEQ ID NO: 1179 - protein, 9 aa, Human papillomavirus type 16
FIYEGNKCL

SEQ ID NO: 1180 - protein, 9 aa, Human papillomavirus type 16
IYEGNKCLL

SEQ ID NO: 1181 - protein, 9 aa, Human papillomavirus type 16
IYLIGLVLL

SEQ ID NO: 1182 - protein, 9 aa, Human papillomavirus type 16
YLIGLVLLV

SEQ ID NO: 1183 - protein, 9 aa, Human papillomavirus type 16
VLLVKMYQT

SEQ ID NO: 1184 - protein, 9 aa, Human papillomavirus type 16
KMYQTIYTL

SEQ ID NO: 1185 - protein, 9 aa, Human papillomavirus type 16
IYTLKALGL

SEQ ID NO: 1186 - protein, 10 aa, Human papillomavirus type 16
LVLWTLLHYR

SEQ ID NO: 1187 - protein, 10 aa, Human papillomavirus type 16
VLWTLLHYRL

SEQ ID NO: 1188 - protein, 10 aa, Human papillomavirus type 16
TLLHYRLTKV

SEQ ID NO: 1189 - protein, 10 aa, Human papillomavirus type 16
YRLTKVKFHW

SEQ ID NO: 1190 - protein, 10 aa, Human papillomavirus type 16
RLTKVKFHWI

SEQ ID NO: 1191 - protein, 10 aa, Human papillomavirus type 16
KFHWIFVHLF

SEQ ID NO: 1192 - protein, 10 aa, Human papillomavirus type 16
HLFANIQIIL

SEQ ID NO: 1193 - protein, 10 aa, Human papillomavirus type 16
CQNHMATAYF

SEQ ID NO: 1194 - protein, 10 aa, Human papillomavirus type 16
HMATAYFFIY

SEQ ID NO: 1195 - protein, 10 aa, Human papillomavirus type 16
FFIYEGNKCL

SEQ ID NO: 1196 - protein, 10 aa, Human papillomavirus type 16
FIYEGNKCLL

SEQ ID NO: 1197 - protein, 10 aa, Human papillomavirus type 16
CLLDIYLIGL

SEQ ID NO: 1198 - protein, 10 aa, Human papillomavirus type 16
YLIGLVLLVK

SEQ ID NO: 1199 - protein, 10 aa, Human papillomavirus type 16
KMYQTIYTLK

SEQ ID NO: 1200 - protein, 10 aa, Human papillomavirus type 16
IYTLKALGLL

SEQ ID NO: 1201 - protein, 8 aa, Human papillomavirus type 16
HRATIMAF

SEQ ID NO: 1202 - protein, 8 aa, Human papillomavirus type 16
RATIMAFV

SEQ ID NO: 1203 - protein, 8 aa, Human papillomavirus type 16
TNYLLLLL

SEQ ID NO: 1204 - protein, 8 aa, Human papillomavirus type 16
VQICHYVL

SEQ ID NO: 1205 - protein, 8 aa, Human papillomavirus type 16
CHYVLPYL

SEQ ID NO: 1206 - protein, 8 aa, Human papillomavirus type 16
LPYLLQKL

SEQ ID NO: 1207 - protein, 8 aa, Human papillomavirus type 16
LHIKILTL

SEQ ID NO: 1208 - protein, 8 aa, Human papillomavirus type 16
GRNMIYSL

SEQ ID NO: 1209 - protein, 8 aa, Human papillomavirus type 16
SLFFNCAK

SEQ ID NO: 1210 - protein, 9 aa, Human papillomavirus type 16
MPKYSINLI

SEQ ID NO: 1211 - protein, 9 aa, Human papillomavirus type 16
HRATIMAFV

SEQ ID NO: 1212 - protein, 9 aa, Human papillomavirus type 16
AFVGVTNYL

SEQ ID NO: 1213 - protein, 9 aa, Human papillomavirus type 16
VGVTNYLLL

SEQ ID NO: 1214 - protein, 9 aa, Human papillomavirus type 16
NYLLLLLIL

SEQ ID NO: 1215 - protein, 9 aa, Human papillomavirus type 16
LLLLILHAV

SEQ ID NO: 1216 - protein, 9 aa, Human papillomavirus type 16
HAVQICHYV

SEQ ID NO: 1217 - protein, 9 aa, Human papillomavirus type 16
CHYVLPYLL

SEQ ID NO: 1218 - protein, 9 aa, Human papillomavirus type 16
YVLPYLLQK

SEQ ID NO: 1219 - protein, 9 aa, Human papillomavirus type 16
KLHIKILTL

SEQ ID NO: 1220 - protein, 9 aa, Human papillomavirus type 16
LRSTYDMGR

SEQ ID NO: 1221 - protein, 9 aa, Human papillomavirus type 16
GRNMIYSLF

SEQ ID NO: 1222 - protein, 10 aa, Human papillomavirus type 16
IGYNEHRATI

SEQ ID NO: 1223 - protein, 10 aa, Human papillomavirus type 16
GYNEHRATIM

SEQ ID NO: 1224 - protein, 10 aa, Human papillomavirus type 16
RATIMAFVGV

SEQ ID NO: 1225 - protein, 10 aa, Human papillomavirus type 16
MAFVGVTNYL

SEQ ID NO: 1226 - protein, 10 aa, Human papillomavirus type 16
AFVGVTNYLL

SEQ ID NO: 1227 - protein, 10 aa, Human papillomavirus type 16
TNYLLLLLIL

SEQ ID NO: 1228 - protein, 10 aa, Human papillomavirus type 16
YLLLLLILHA

SEQ ID NO: 1229 - protein, 10 aa, Human papillomavirus type 16
LLLLLILHAV

SEQ ID NO: 1230 - protein, 10 aa, Human papillomavirus type 16
HAVQICHYVL

SEQ ID NO: 1231 - protein, 10 aa, Human papillomavirus type 16
VQICHYVLPY

SEQ ID NO: 1232 - protein, 10 aa, Human papillomavirus type 16
YVLPYLLQKL

SEQ ID NO: 1233 - protein, 10 aa, Human papillomavirus type 16
LPYLLQKLHI

SEQ ID NO: 1234 - protein, 10 aa, Human papillomavirus type 16
YLLQKLHIKI

SEQ ID NO: 1235 - protein, 10 aa, Human papillomavirus type 16
LRSTYDMGRN

SEQ ID NO: 1236 - protein, 10 aa, Human papillomavirus type 16
GRNMIYSLFF

SEQ ID NO: 1237 - protein, 8 aa, Human papillomavirus type 16
CMYVELVL

SEQ ID NO: 1238 - protein, 9 aa, Human papillomavirus type 16
CKYCMYVEL

SEQ ID NO: 1239 - protein, 9 aa, Human papillomavirus type 16
CMYVELVLF

SEQ ID NO: 1240 - protein, 9 aa, Human papillomavirus type 16
VLFVVYMFV

SEQ ID NO: 1241 - protein, 9 aa, Human papillomavirus type 16
VYMFVCACM

SEQ ID NO: 1242 - protein, 9 aa, Human papillomavirus type 16
MFVCACMCL

SEQ ID NO: 1243 - protein, 10 aa, Human papillomavirus type 16
KYCMYVELVL

SEQ ID NO: 1244 - protein, 10 aa, Human papillomavirus type 16
CMYVELVLFV

SEQ ID NO: 1245 - protein, 10 aa, Human papillomavirus type 16
LVLFVVYMFV

SEQ ID NO: 1246 - protein, 10 aa, Human papillomavirus type 16
VLFVVYMFVC

SEQ ID NO: 1247 - protein, 10 aa, Human papillomavirus type 16
YMFVCACMCL

SEQ ID NO: 1248 - protein, 9 aa, Human papillomavirus type 16
FLFYIYYIL

SEQ ID NO: 1249 - protein, 10 aa, Human papillomavirus type 16
LFLFYIYYIL

SEQ ID NO: 1250 - protein, 8 aa, Human papillomavirus type 16
CQPFHCFL

SEQ ID NO: 1251 - protein, 9 aa, Human papillomavirus type 16
LLGTYFWLV

SEQ ID NO: 1252 - protein, 9 aa, Human papillomavirus type 16
YFWLVLTNL

SEQ ID NO: 1253 - protein, 9 aa, Human papillomavirus type 16
VLTNLIAYL

SEQ ID NO: 1254 - protein, 10 aa, Human papillomavirus type 16
TYFWLVLTNL

SEQ ID NO: 1255 - protein, 10 aa, Human papillomavirus type 16
LVLTNLIAYL

SEQ ID NO: 1256 - protein, 8 aa, Human papillomavirus type 16
HRAANNYT

SEQ ID NO: 1257 - protein, 9 aa, Human papillomavirus type 16
VLLQIIKNT

SEQ ID NO: 1258 - protein, 8 aa, Human papillomavirus type 16
MHGDTPTL

SEQ ID NO: 1259 - protein, 8 aa, Human papillomavirus type 16
LHEYMLDL

SEQ ID NO: 1260 - protein, 8 aa, Human papillomavirus type 16
LQPETTDL

SEQ ID NO: 1261 - protein, 8 aa, Human papillomavirus type 16
LRLCVQST

SEQ ID NO: 1262 - protein, 8 aa, Human papillomavirus type 16
THVDIRTL

SEQ ID NO: 1263 - protein, 8 aa, Human papillomavirus type 16
IRTLEDLL

SEQ ID NO: 1264 - protein, 9 aa, Human papillomavirus type 16
TPTLHEYML

SEQ ID NO: 1265 - protein, 9 aa, Human papillomavirus type 16
TLHEYMLDL

SEQ ID NO: 1266 - protein, 9 aa, Human papillomavirus type 16
YMLDLQPET

SEQ ID NO: 1267 - protein, 9 aa, Human papillomavirus type 16
LQPETTDLY

SEQ ID NO: 1268 - protein, 9 aa, Human papillomavirus type 16
TDLYCYEQL

SEQ ID NO: 1269 - protein, 9 aa, Human papillomavirus type 16
QAEPDRAHY

SEQ ID NO: 1270 - protein, 9 aa, Human papillomavirus type 16
EPDRAHYNI

SEQ ID NO: 1271 - protein, 9 aa, Human papillomavirus type 16
LRLCVQSTH

SEQ ID NO: 1272 - protein, 9 aa, Human papillomavirus type 16
VQSTHVDIR

SEQ ID NO: 1273 - protein, 9 aa, Human papillomavirus type 16
IRTLEDLLM

SEQ ID NO: 1274 - protein, 9 aa, Human papillomavirus type 16
LEDLLMGTL

SEQ ID NO: 1275 - protein, 10 aa, Human papillomavirus type 16
YMLDLQPETT

SEQ ID NO: 1276 - protein, 10 aa, Human papillomavirus type 16
DEIDGPAGQA

SEQ ID NO: 1277 - protein, 10 aa, Human papillomavirus type 16
GQAEPDRAHY

SEQ ID NO: 1278 - protein, 10 aa, Human papillomavirus type 16
EPDRAHYNIV

SEQ ID NO: 1279 - protein, 10 aa, Human papillomavirus type 16
DRAHYNIVTF

SEQ ID NO: 1280 - protein, 10 aa, Human papillomavirus type 16
TFCCKCDSTL

SEQ ID NO: 1281 - protein, 10 aa, Human papillomavirus type 16
LRLCVQSTHV

SEQ ID NO: 1282 - protein, 10 aa, Human papillomavirus type 16
CVQSTHVDIR

SEQ ID NO: 1283 - protein, 10 aa, Human papillomavirus type 16
VDIRTLEDLL

SEQ ID NO: 1284 - protein, 8 aa, Human papillomavirus type 16
AQEAKQHR

SEQ ID NO: 1285 - protein, 8 aa, Human papillomavirus type 16
HRDAVQVL

SEQ ID NO: 1286 - protein, 8 aa, Human papillomavirus type 16
KRKYLVVH

SEQ ID NO: 1287 - protein, 9 aa, Human papillomavirus type 16
NGWFYVEAV

SEQ ID NO: 1288 - protein, 9 aa, Human papillomavirus type 16
GWFYVEAVV

SEQ ID NO: 1289 - protein, 9 aa, Human papillomavirus type 16
YVEAVVEKK

SEQ ID NO: 1290 - protein, 9 aa, Human papillomavirus type 16
AETETAHAL

SEQ ID NO: 1291 - protein, 9 aa, Human papillomavirus type 16
ALFTAQEAK

SEQ ID NO: 1292 - protein, 9 aa, Human papillomavirus type 16
EAKQHRDAV

SEQ ID NO: 1293 - protein, 9 aa, Human papillomavirus type 16
KQHRDAVQV

SEQ ID NO: 1294 - protein, 9 aa, Human papillomavirus type 16
HRDAVQVLK

SEQ ID NO: 1295 - protein, 9 aa, Human papillomavirus type 16
KRKYLVVHL

SEQ ID NO: 1296 - protein, 9 aa, Human papillomavirus type 16
KYLVVHLVI

SEQ ID NO: 1297 - protein, 10 aa, Human papillomavirus type 16
NGWFYVEAVV

SEQ ID NO: 1298 - protein, 10 aa, Human papillomavirus type 16
TGEDLVDFIV

SEQ ID NO: 1299 - protein, 10 aa, Human papillomavirus type 16
DFIVNDNDYL

SEQ ID NO: 1300 - protein, 10 aa, Human papillomavirus type 16
FTAQEAKQHR

SEQ ID NO: 1301 - protein, 10 aa, Human papillomavirus type 16
KQHRDAVQVL

SEQ ID NO: 1302 - protein, 10 aa, Human papillomavirus type 16
HRDAVQVLKR

SEQ ID NO: 1303 - protein, 10 aa, Human papillomavirus type 16
KRKYLVVHLV

SEQ ID NO: 1304 - protein, 10 aa, Human papillomavirus type 16
KYLVVHLVIL

SEQ ID NO: 1305 - protein, 10 aa, Human papillomavirus type 16
YLVVHLVILV

SEQ ID NO: 1306 - protein, 8 aa, Human papillomavirus type 16
MRLKHHVV

SEQ ID NO: 1307 - protein, 9 aa, Human papillomavirus type 16
MRLKHHVVS

SEQ ID NO: 1308 - protein, 10 aa, Human papillomavirus type 16
MRLKHHVVSI

SEQ ID NO: 1309 - protein, 8 aa, Human papillomavirus type 16
RQNGYKDK

SEQ ID NO: 1310 - protein, 8 aa, Human papillomavirus type 16
KQYYNIVL

SEQ ID NO: 1311 - protein, 8 aa, Human papillomavirus type 16
HRWYNGPT

SEQ ID NO: 1312 - protein, 9 aa, Human papillomavirus type 16
TRQNGYKDK

SEQ ID NO: 1313 - protein, 9 aa, Human papillomavirus type 16
KQYYNIVLM

SEQ ID NO: 1314 - protein, 9 aa, Human papillomavirus type 16
HRWYNGPTI

SEQ ID NO: 1315 - protein, 10 aa, Human papillomavirus type 16
KQYYNIVLMI

SEQ ID NO: 1316 - protein, 10 aa, Human papillomavirus type 16
QYYNIVLMIV

SEQ ID NO: 1317 - protein, 10 aa, Human papillomavirus type 16
HRWYNGPTIM

SEQ ID NO: 1318 - protein, 9 aa, Human papillomavirus type 16
MEVIGSKLL

SEQ ID NO: 1319 - protein, 9 aa, Human papillomavirus type 16
VQLTQVNHY

SEQ ID NO: 1320 - protein, 9 aa, Human papillomavirus type 16
QLTQVNHYL

SEQ ID NO: 1321 - protein, 10 aa, Human papillomavirus type 16
VQLTQVNHYL

SEQ ID NO: 1322 - protein, 8 aa, Human papillomavirus type 16
LRDHIDYW

SEQ ID NO: 1323 - protein, 8 aa, Human papillomavirus type 16
MRLECAIY

SEQ ID NO: 1324 - protein, 9 aa, Human papillomavirus type 16
QRLNVCQDK

SEQ ID NO: 1325 - protein, 9 aa, Human papillomavirus type 16
CQDKILTHY

SEQ ID NO: 1326 - protein, 9 aa, Human papillomavirus type 16
HYENDSTDL

SEQ ID NO: 1327 - protein, 9 aa, Human papillomavirus type 16
LRDHIDYWK

SEQ ID NO: 1328 - protein, 9 aa, Human papillomavirus type 16
DHIDYWKHM

SEQ ID NO: 1329 - protein, 9 aa, Human papillomavirus type 16
MRLECAIYY

SEQ ID NO: 1330 - protein, 9 aa, Human papillomavirus type 16
YYKAREMGF

SEQ ID NO: 1331 - protein, 9 aa, Human papillomavirus type 16
AREMGFKHI

SEQ ID NO: 1332 - protein, 9 aa, Human papillomavirus type 16
VVPTLAVSK

SEQ ID NO: 1333 - protein, 10 aa, Human papillomavirus type 16
CQRLNVCQDK

SEQ ID NO: 1334 - protein, 10 aa, Human papillomavirus type 16
QRLNVCQDKI

SEQ ID NO: 1335 - protein, 10 aa, Human papillomavirus type 16
THYENDSTDL

SEQ ID NO: 1336 - protein, 10 aa, Human papillomavirus type 16
STDLRDHIDY

SEQ ID NO: 1337 - protein, 10 aa, Human papillomavirus type 16
LRDHIDYWKH

SEQ ID NO: 1338 - protein, 10 aa, Human papillomavirus type 16
MRLECAIYYK

SEQ ID NO: 1339 - protein, 10 aa, Human papillomavirus type 16
IYYKAREMGF

SEQ ID NO: 1340 - protein, 10 aa, Human papillomavirus type 16
KAREMGFKHI

SEQ ID NO: 1341 - protein, 10 aa, Human papillomavirus type 16
AREMGFKHIN

SEQ ID NO: 1342 - protein, 10 aa, Human papillomavirus type 16
MGFKHINHQV

SEQ ID NO: 1343 - protein, 10 aa, Human papillomavirus type 16
QVVPTLAVSK

SEQ ID NO: 1344 - protein, 8 aa, Human papillomavirus type 16
MQEHPDYL

SEQ ID NO: 1345 - protein, 8 aa, Human papillomavirus type 16
EHPDYLQL

SEQ ID NO: 1346 - protein, 8 aa, Human papillomavirus type 16
LQLDIPIF

SEQ ID NO: 1347 - protein, 9 aa, Human papillomavirus type 16
NMLHAQTYI

SEQ ID NO: 1348 - protein, 9 aa, Human papillomavirus type 16
IMQEHPDYL

SEQ ID NO: 1349 - protein, 9 aa, Human papillomavirus type 16
QEHPDYLQL

SEQ ID NO: 1350 - protein, 9 aa, Human papillomavirus type 16
HPDYLQLDI

SEQ ID NO: 1351 - protein, 9 aa, Human papillomavirus type 16
LQLDIPIFL

SEQ ID NO: 1352 - protein, 9 aa, Human papillomavirus type 16
QLDIPIFLL

SEQ ID NO: 1353 - protein, 9 aa, Human papillomavirus type 16
IPIFLLKNL

SEQ ID NO: 1354 - protein, 9 aa, Human papillomavirus type 16
FLLKNLTIT

SEQ ID NO: 1355 - protein, 10 aa, Human papillomavirus type 16
MQEHPDYLQL

SEQ ID NO: 1356 - protein, 10 aa, Human papillomavirus type 16
DYLQLDIPIF

SEQ ID NO: 1357 - protein, 10 aa, Human papillomavirus type 16
YLQLDIPIFL

SEQ ID NO: 1358 - protein, 10 aa, Human papillomavirus type 16
LQLDIPIFLL

SEQ ID NO: 1359 - protein, 10 aa, Human papillomavirus type 16
QLDIPIFLLK

SEQ ID NO: 1360 - protein, 10 aa, Human papillomavirus type 16
LLKNLTITKY

SEQ ID NO: 1361 - protein, 9 aa, Human papillomavirus type 16
KMLVLMQQM

SEQ ID NO: 1362 - protein, 9 aa, Human papillomavirus type 16
MQQMQVWII

SEQ ID NO: 1363 - protein, 9 aa, Human papillomavirus type 16
NVYLWITNK

SEQ ID NO: 1364 - protein, 10 aa, Human papillomavirus type 16
MLVLMQQMQV

SEQ ID NO: 1365 - protein, 10 aa, Human papillomavirus type 16
VLMQQMQVWI

SEQ ID NO: 1366 - protein, 10 aa, Human papillomavirus type 16
MQVWIIENVY

SEQ ID NO: 1367 - protein, 10 aa, Human papillomavirus type 16
WIIENVYLWI

SEQ ID NO: 1368 - protein, 10 aa, Human papillomavirus type 16
YLWITNKHNC

SEQ ID NO: 1369 - protein, 9 aa, Human papillomavirus type 16
VIWFILALV

SEQ ID NO: 1370 - protein, 9 aa, Human papillomavirus type 16
FILALVLWT

SEQ ID NO: 1371 - protein, 9 aa, Human papillomavirus type 16
ILALVLWTL

SEQ ID NO: 1372 - protein, 10 aa, Human papillomavirus type 16
FILALVLWTL

SEQ ID NO: 1373 - protein, 8 aa, Human papillomavirus type 16
YGIINTCV

SEQ ID NO: 1374 - protein, 9 aa, Human papillomavirus type 16
TCVCVFKCL

SEQ ID NO: 1375 - protein, 9 aa, Human papillomavirus type 16
CNYCVMQHK

SEQ ID NO: 1376 - protein, 10 aa, Human papillomavirus type 16
CMYGIINTCV

SEQ ID NO: 1377 - protein, 10 aa, Human papillomavirus type 16
YGIINTCVCV

SEQ ID NO: 1378 - protein, 9 aa, Human papillomavirus type 16
LFGTKCVFL

SEQ ID NO: 1379 - protein, 10 aa, Human papillomavirus type 16
MLFGTKCVFL

SEQ ID NO: 1380 - protein, 8 aa, Human papillomavirus type 16
APTPYIPL

SEQ ID NO: 1381 - protein, 9 aa, Human papillomavirus type 16
YAPTPYIPL

SEQ ID NO: 1382 - protein, 9 aa, Human papillomavirus type 16
APTPYIPLL

SEQ ID NO: 1383 - protein, 10 aa, Human papillomavirus type 16
HYAPTPYIPL

SEQ ID NO: 1384 - protein, 10 aa, Human papillomavirus type 16
YAPTPYIPLL

SEQ ID NO: 1385 - protein, 10 aa, Human papillomavirus type 16
IPLLGTYFWL

SEQ ID NO: 1386 - protein, 8 aa, Human papillomavirus type 16
LRREVYDF

SEQ ID NO: 1387 - protein, 8 aa, Human papillomavirus type 16
RREVYDFA

SEQ ID NO: 1388 - protein, 8 aa, Human papillomavirus type 16
FAFRDLCI

SEQ ID NO: 1389 - protein, 8 aa, Human papillomavirus type 16
FRDLCIVY

SEQ ID NO: 1390 - protein, 8 aa, Human papillomavirus type 16
YRDGNPYA

SEQ ID NO: 1391 - protein, 8 aa, Human papillomavirus type 16
YAVCDKCL

SEQ ID NO: 1392 - protein, 8 aa, Human papillomavirus type 16
YRHYCYSL

SEQ ID NO: 1393 - protein, 8 aa, Human papillomavirus type 16
QQYNKPLC

SEQ ID NO: 1394 - protein, 8 aa, Human papillomavirus type 16
KPLCDLLI

SEQ ID NO: 1395 - protein, 8 aa, Human papillomavirus type 16
IRCINCQK

SEQ ID NO: 1396 - protein, 8 aa, Human papillomavirus type 16
KQRHLDKK

SEQ ID NO: 1397 - protein, 8 aa, Human papillomavirus type 16
KQRFHNIR

SEQ ID NO: 1398 - protein, 8 aa, Human papillomavirus type 16
IRGRWTGR

SEQ ID NO: 1399 - protein, 8 aa, Human papillomavirus type 16
GRWTGRCM

SEQ ID NO: 1400 - protein, 8 aa, Human papillomavirus type 16
GRCMSCCR

SEQ ID NO: 1401 - protein, 8 aa, Human papillomavirus type 16
CRSSRTRR

SEQ ID NO: 1402 - protein, 9 aa, Human papillomavirus type 16
LQTTIHDII

SEQ ID NO: 1403 - protein, 9 aa, Human papillomavirus type 16
IHDIILECV

SEQ ID NO: 1404 - protein, 9 aa, Human papillomavirus type 16
QQLLRREVY

SEQ ID NO: 1405 - protein, 9 aa, Human papillomavirus type 16
LLRREVYDF

SEQ ID NO: 1406 - protein, 9 aa, Human papillomavirus type 16
LRREVYDFA

SEQ ID NO: 1407 - protein, 9 aa, Human papillomavirus type 16
RREVYDFAF

SEQ ID NO: 1408 - protein, 9 aa, Human papillomavirus type 16
VYDFAFRDL

SEQ ID NO: 1409 - protein, 9 aa, Human papillomavirus type 16
FAFRDLCIV

SEQ ID NO: 1410 - protein, 9 aa, Human papillomavirus type 16
FRDLCIVYR

SEQ ID NO: 1411 - protein, 9 aa, Human papillomavirus type 16
YRDGNPYAV

SEQ ID NO: 1412 - protein, 9 aa, Human papillomavirus type 16
NPYAVCDKC

SEQ ID NO: 1413 - protein, 9 aa, Human papillomavirus type 16
ISEYRHYCY

SEQ ID NO: 1414 - protein, 9 aa, Human papillomavirus type 16
EYRHYCYSL

SEQ ID NO: 1415 - protein, 9 aa, Human papillomavirus type 16
YRHYCYSLY

SEQ ID NO: 1416 - protein, 9 aa, Human papillomavirus type 16
CYSLYGTTL

SEQ ID NO: 1417 - protein, 9 aa, Human papillomavirus type 16
LEQQYNKPL

SEQ ID NO: 1418 - protein, 9 aa, Human papillomavirus type 16
QYNKPLCDL

SEQ ID NO: 1419 - protein, 9 aa, Human papillomavirus type 16
CPEEKQRHL

SEQ ID NO: 1420 - protein, 9 aa, Human papillomavirus type 16
QRHLDKKQR

SEQ ID NO: 1421 - protein, 9 aa, Human papillomavirus type 16
QRFHNIRGR

SEQ ID NO: 1422 - protein, 9 aa, Human papillomavirus type 16
IRGRWTGRC

SEQ ID NO: 1423 - protein, 9 aa, Human papillomavirus type 16
GRWTGRCMS

SEQ ID NO: 1424 - protein, 9 aa, Human papillomavirus type 16
GRCMSCCRS

SEQ ID NO: 1425 - protein, 9 aa, Human papillomavirus type 16
SRTRRETQL

SEQ ID NO: 1426 - protein, 10 aa, Human papillomavirus type 16
LQTTIHDIIL

SEQ ID NO: 1427 - protein, 10 aa, Human papillomavirus type 16
LECVYCKQQL

SEQ ID NO: 1428 - protein, 10 aa, Human papillomavirus type 16
CVYCKQQLLR

SEQ ID NO: 1429 - protein, 10 aa, Human papillomavirus type 16
KQQLLRREVY

SEQ ID NO: 1430 - protein, 10 aa, Human papillomavirus type 16
LRREVYDFAF

SEQ ID NO: 1431 - protein, 10 aa, Human papillomavirus type 16
RREVYDFAFR

SEQ ID NO: 1432 - protein, 10 aa, Human papillomavirus type 16
EVYDFAFRDL

SEQ ID NO: 1433 - protein, 10 aa, Human papillomavirus type 16
YRDGNPYAVC

SEQ ID NO: 1434 - protein, 10 aa, Human papillomavirus type 16
NPYAVCDKCL

SEQ ID NO: 1435 - protein, 10 aa, Human papillomavirus type 16
SEYRHYCYSL

SEQ ID NO: 1436 - protein, 10 aa, Human papillomavirus type 16
QQYNKPLCDL

SEQ ID NO: 1437 - protein, 10 aa, Human papillomavirus type 16
QYNKPLCDLL

SEQ ID NO: 1438 - protein, 10 aa, Human papillomavirus type 16
IRCINCQKPL

SEQ ID NO: 1439 - protein, 10 aa, Human papillomavirus type 16
CQKPLCPEEK

SEQ ID NO: 1440 - protein, 10 aa, Human papillomavirus type 16
QRHLDKKQRF

SEQ ID NO: 1441 - protein, 10 aa, Human papillomavirus type 16
QRFHNIRGRW

SEQ ID NO: 1442 - protein, 10 aa, Human papillomavirus type 16
IRGRWTGRCM

SEQ ID NO: 1443 - protein, 10 aa, Human papillomavirus type 16
GRWTGRCMSC

SEQ ID NO: 1444 - protein, 10 aa, Human papillomavirus type 16
WTGRCMSCCR

SEQ ID NO: 1445 - protein, 8 aa, Human papillomavirus type 16
KQNRTEPI

SEQ ID NO: 1446 - protein, 8 aa, Human papillomavirus type 16
NRTEPITI

SEQ ID NO: 1447 - protein, 9 aa, Human papillomavirus type 16
NRTEPITIL

SEQ ID NO: 1448 - protein, 10 aa, Human papillomavirus type 16
KQNRTEPITI

SEQ ID NO: 1449 - protein, 8 aa, Human papillomavirus type 16
VRDVMDGF

SEQ ID NO: 1450 - protein, 9 aa, Human papillomavirus type 16
QVPMGKRVR

SEQ ID NO: 1451 - protein, 9 aa, Human papillomavirus type 16
VRDVMDGFM

SEQ ID NO: 1452 - protein, 10 aa, Human papillomavirus type 16
ILQVPMGKRV

SEQ ID NO: 1453 - protein, 10 aa, Human papillomavirus type 16
VPMGKRVRDV

SEQ ID NO: 1454 - protein, 10 aa, Human papillomavirus type 16
KRVRDVMDGF

SEQ ID NO: 1455 - protein, 9 aa, Human papillomavirus type 16
HRKQNNIEM

SEQ ID NO: 1456 - protein, 9 aa, Human papillomavirus type 16
KQNNIEMQY

SEQ ID NO: 1457 - protein, 10 aa, Human papillomavirus type 16
KQNNIEMQYR

SEQ ID NO: 1458 - protein, 8 aa, Human papillomavirus type 16
ARGRGQGK

SEQ ID NO: 1459 - protein, 8 aa, Human papillomavirus type 16
KRWRLFAN

SEQ ID NO: 1460 - protein, 9 aa, Human papillomavirus type 16
DVVQIKFAR

SEQ ID NO: 1461 - protein, 9 aa, Human papillomavirus type 16
ARGRGQGKR

SEQ ID NO: 1462 - protein, 9 aa, Human papillomavirus type 16
GRGQGKRWR

SEQ ID NO: 1463 - protein, 9 aa, Human papillomavirus type 16
GQGKRWRLF

SEQ ID NO: 1464 - protein, 9 aa, Human papillomavirus type 16
KRWRLFANV

SEQ ID NO: 1465 - protein, 10 aa, Human papillomavirus type 16
ILFLKDVVQI

SEQ ID NO: 1466 - protein, 10 aa, Human papillomavirus type 16
FLKDVVQIKF

SEQ ID NO: 1467 - protein, 10 aa, Human papillomavirus type 16
VVQIKFARGR

SEQ ID NO: 1468 - protein, 10 aa, Human papillomavirus type 16
GRGQGKRWRL

SEQ ID NO: 1469 - protein, 8 aa, Human papillomavirus type 16
YQRIKHYK

SEQ ID NO: 1470 - protein, 9 aa, Human papillomavirus type 16
QRIKHYKQL

SEQ ID NO: 1471 - protein, 10 aa, Human papillomavirus type 16
QRIKHYKQLN

SEQ ID NO: 1472 - protein, 8 aa, Human papillomavirus type 16
TQWTVLQS

SEQ ID NO: 1473 - protein, 9 aa, Human papillomavirus type 16
TKYPLLKLL

SEQ ID NO: 1474 - protein, 9 aa, Human papillomavirus type 16
KLLGSTWPT

SEQ ID NO: 1475 - protein, 9 aa, Human papillomavirus type 16
WPTTPPRPI

SEQ ID NO: 1476 - protein, 9 aa, Human papillomavirus type 16
WAPKKHRRL

SEQ ID NO: 1477 - protein, 9 aa, Human papillomavirus type 16
TQWTVLQSS

SEQ ID NO: 1478 - protein, 10 aa, Human papillomavirus type 16
AATKYPLLKL

SEQ ID NO: 1479 - protein, 10 aa, Human papillomavirus type 16
KLLGSTWPTT

SEQ ID NO: 1480 - protein, 10 aa, Human papillomavirus type 16
RRLSSDQDQS

SEQ ID NO: 1481 - protein, 10 aa, Human papillomavirus type 16
TQWTVLQSSL

SEQ ID NO: 1482 - protein, 10 aa, Human papillomavirus type 16
TAHTKDGLTV

SEQ ID NO: 1483 - protein, 10 aa, Human papillomavirus type 16
CRLHGIGQDI

SEQ ID NO: 1484 - protein, 8 aa, Human papillomavirus type 16
SAFRCFIV

SEQ ID NO: 1485 - protein, 8 aa, Human papillomavirus type 16
FRCFIVYI

SEQ ID NO: 1486 - protein, 9 aa, Human papillomavirus type 16
LLLSVSTYT

SEQ ID NO: 1487 - protein, 9 aa, Human papillomavirus type 16
LSVSTYTSL

SEQ ID NO: 1488 - protein, 9 aa, Human papillomavirus type 16
IILVLLLWI

SEQ ID NO: 1489 - protein, 9 aa, Human papillomavirus type 16
AASAFRCFI

SEQ ID NO: 1490 - protein, 9 aa, Human papillomavirus type 16
FRCFIVYII

SEQ ID NO: 1491 - protein, 9 aa, Human papillomavirus type 16
YIIFVYIPL

SEQ ID NO: 1492 - protein, 9 aa, Human papillomavirus type 16
IFVYIPLFL

SEQ ID NO: 1493 - protein, 9 aa, Human papillomavirus type 16
FVYIPLFLI

SEQ ID NO: 1494 - protein, 10 aa, Human papillomavirus type 16
TYTSLIILVL

SEQ ID NO: 1495 - protein, 10 aa, Human papillomavirus type 16
TAASAFRCFI

SEQ ID NO: 1496 - protein, 10 aa, Human papillomavirus type 16
AASAFRCFIV

SEQ ID NO: 1497 - protein, 10 aa, Human papillomavirus type 16
SAFRCFIVYI

SEQ ID NO: 1498 - protein, 10 aa, Human papillomavirus type 16
FRCFIVYIIF

SEQ ID NO: 1499 - protein, 10 aa, Human papillomavirus type 16
VYIIFVYIPL

SEQ ID NO: 1500 - protein, 10 aa, Human papillomavirus type 16
IIFVYIPLFL

SEQ ID NO: 1501 - protein, 10 aa, Human papillomavirus type 16
LFLIHTHARF

SEQ ID NO: 1502 - protein, 10 aa, Human papillomavirus type 16
FLIHTHARFL

SEQ ID NO: 1503 - protein, 8 aa, Human papillomavirus type 16
QRIPMYQC

SEQ ID NO: 1504 - protein, 8 aa, Human papillomavirus type 16
YQCCSKSR

SEQ ID NO: 1505 - protein, 9 aa, Human papillomavirus type 16
QRIPMYQCC

SEQ ID NO: 1506 - protein, 10 aa, Human papillomavirus type 16
QRIPMYQCCS

SEQ ID NO: 1507 - protein, 8 aa, Human papillomavirus type 16
RRHTRRYL

SEQ ID NO: 1508 - protein, 9 aa, Human papillomavirus type 16
SPRRHTRRY

SEQ ID NO: 1509 - protein, 10 aa, Human papillomavirus type 16
SPRRHTRRYL

SEQ ID NO: 1510 - protein, 8 aa, Human papillomavirus type 16
MRAKSLFS

SEQ ID NO: 1511 - protein, 9 aa, Human papillomavirus type 16
HSIVFYTAL

SEQ ID NO: 1512 - protein, 10 aa, Human papillomavirus type 16
TALCATTESL

SEQ ID NO: 1513 - protein, 8 aa, Human papillomavirus type 16
HQKRTAMF

SEQ ID NO: 1514 - protein, 8 aa, Human papillomavirus type 16
RPRKLPQL

SEQ ID NO: 1515 - protein, 8 aa, Human papillomavirus type 16
LPQLCTEL

SEQ ID NO: 1516 - protein, 9 aa, Human papillomavirus type 16
AMFQDPQER

SEQ ID NO: 1517 - protein, 9 aa, Human papillomavirus type 16
DPQERPRKL

SEQ ID NO: 1518 - protein, 9 aa, Human papillomavirus type 16
ERPRKLPQL

SEQ ID NO: 1519 - protein, 10 aa, Human papillomavirus type 16
FQDPQERPRK

SEQ ID NO: 1520 - protein, 10 aa, Human papillomavirus type 16
QERPRKLPQL

SEQ ID NO: 1521 - protein, 10 aa, Human papillomavirus type 16
RKLPQLCTEL

SEQ ID NO: 1522 - protein, 8 aa, Human papillomavirus type 16
VQLDKQNR

SEQ ID NO: 1523 - protein, 9 aa, Human papillomavirus type 16
MVQLDKQNR

SEQ ID NO: 1524 - protein, 8 aa, Human papillomavirus type 16
TRTKMTVI

SEQ ID NO: 1525 - protein, 8 aa, Human papillomavirus type 16
KMTVIQVK

SEQ ID NO: 1526 - protein, 9 aa, Human papillomavirus type 16
LYQMTRTKM

SEQ ID NO: 1527 - protein, 10 aa, Human papillomavirus type 16
YQMTRTKMTV

SEQ ID NO: 1528 - protein, 10 aa, Human papillomavirus type 16
TRTKMTVIQV

SEQ ID NO: 1529 - protein, 8 aa, Human papillomavirus type 16
MRCLLHRK

SEQ ID NO: 1530 - protein, 9 aa, Human papillomavirus type 16
NGCVTISKI

SEQ ID NO: 1531 - protein, 9 aa, Human papillomavirus type 16
CVSNVYDDR

SEQ ID NO: 1532 - protein, 9 aa, Human papillomavirus type 16
NVYDDRASK

SEQ ID NO: 1533 - protein, 8 aa, Human papillomavirus type 16
MPSIINYI

SEQ ID NO: 1534 - protein, 8 aa, Human papillomavirus type 16
GHYKTLAL

SEQ ID NO: 1535 - protein, 8 aa, Human papillomavirus type 16
IQWKCSLM

SEQ ID NO: 1536 - protein, 9 aa, Human papillomavirus type 16
ETYAIQCII

SEQ ID NO: 1537 - protein, 9 aa, Human papillomavirus type 16
IQTGHIYIF

SEQ ID NO: 1538 - protein, 10 aa, Human papillomavirus type 16
IQWKCSLMET

SEQ ID NO: 1539 - protein, 9 aa, Human papillomavirus type 16
EYEHILCSL

SEQ ID NO: 1540 - protein, 9 aa, Human papillomavirus type 16
KMMQKNIVK

SEQ ID NO: 1541 - protein, 10 aa, Human papillomavirus type 16
MFMKEYEHIL

SEQ ID NO: 1542 - protein, 10 aa, Human papillomavirus type 16
KEYEHILCSL

SEQ ID NO: 1543 - protein, 10 aa, Human papillomavirus type 16
KMMQKNIVKI

SEQ ID NO: 1544 - protein, 10 aa, Human papillomavirus type 16
MQKNIVKIKY

SEQ ID NO: 1545 - protein, 8 aa, Human papillomavirus type 16
TNFCLKLK

SEQ ID NO: 1546 - protein, 8 aa, Human papillomavirus type 16
YQKLLQCL

SEQ ID NO: 1547 - protein, 9 aa, Human papillomavirus type 16
CLKLKYQKL

SEQ ID NO: 1548 - protein, 9 aa, Human papillomavirus type 16
KYQKLLQCL

SEQ ID NO: 1549 - protein, 9 aa, Human papillomavirus type 16
YQKLLQCLL

SEQ ID NO: 1550 - protein, 9 aa, Human papillomavirus type 16
KLLQCLLDL

SEQ ID NO: 1551 - protein, 9 aa, Human papillomavirus type 16
LQCLLDLCL

SEQ ID NO: 1552 - protein, 10 aa, Human papillomavirus type 16
NVTNFCLKLK

SEQ ID NO: 1553 - protein, 10 aa, Human papillomavirus type 16
FCLKLKYQKL

SEQ ID NO: 1554 - protein, 10 aa, Human papillomavirus type 16
KYQKLLQCLL

SEQ ID NO: 1555 - protein, 10 aa, Human papillomavirus type 16
LQCLLDLCLY

SEQ ID NO: 1556 - protein, 10 aa, Human papillomavirus type 16
CLLDLCLYDK

SEQ ID NO: 1557 - protein, 8 aa, Human papillomavirus type 16
MRHKRSAK

SEQ ID NO: 1558 - protein, 8 aa, Human papillomavirus type 16
KRSAKRTK

SEQ ID NO: 1559 - protein, 8 aa, Human papillomavirus type 16
KRTKRASA

SEQ ID NO: 1560 - protein, 8 aa, Human papillomavirus type 16
KRASATQL

SEQ ID NO: 1561 - protein, 8 aa, Human papillomavirus type 16
TQLYKTCK

SEQ ID NO: 1562 - protein, 8 aa, Human papillomavirus type 16
LQYGSMGV

SEQ ID NO: 1563 - protein, 8 aa, Human papillomavirus type 16
GRTGYIPL

SEQ ID NO: 1564 - protein, 8 aa, Human papillomavirus type 16
GPSDPSIV

SEQ ID NO: 1565 - protein, 8 aa, Human papillomavirus type 16
DPSIVSLV

SEQ ID NO: 1566 - protein, 8 aa, Human papillomavirus type 16
DAGAPTSV

SEQ ID NO: 1567 - protein, 8 aa, Human papillomavirus type 16
APTSVPSI

SEQ ID NO: 1568 - protein, 8 aa, Human papillomavirus type 16
VPSIPPDV

SEQ ID NO: 1569 - protein, 8 aa, Human papillomavirus type 16
IPMDTFIV

SEQ ID NO: 1570 - protein, 8 aa, Human papillomavirus type 16
RPVARLGL

SEQ ID NO: 1571 - protein, 8 aa, Human papillomavirus type 16
ARLGLYSR

SEQ ID NO: 1572 - protein, 8 aa, Human papillomavirus type 16
SRTTQQVK

SEQ ID NO: 1573 - protein, 8 aa, Human papillomavirus type 16
DPDFLDIV

SEQ ID NO: 1574 - protein, 8 aa, Human papillomavirus type 16
VALHRPAL

SEQ ID NO: 1575 - protein, 8 aa, Human papillomavirus type 16
HRPALTSR

SEQ ID NO: 1576 - protein, 8 aa, Human papillomavirus type 16
SRRTGIRY

SEQ ID NO: 1577 - protein, 8 aa, Human papillomavirus type 16
RRTGIRYS

SEQ ID NO: 1578 - protein, 8 aa, Human papillomavirus type 16
TGIRYSRI

SEQ ID NO: 1579 - protein, 8 aa, Human papillomavirus type 16
IRYSRIGN

SEQ ID NO: 1580 - protein, 8 aa, Human papillomavirus type 16
SRIGNKQT

SEQ ID NO: 1581 - protein, 8 aa, Human papillomavirus type 16
DPAEEIEL

SEQ ID NO: 1582 - protein, 8 aa, Human papillomavirus type 16
HAASPTSI

SEQ ID NO: 1583 - protein, 8 aa, Human papillomavirus type 16
GAYNIPLV

SEQ ID NO: 1584 - protein, 8 aa, Human papillomavirus type 16
GPDIPINI

SEQ ID NO: 1585 - protein, 8 aa, Human papillomavirus type 16
QAPSLIPI

SEQ ID NO: 1586 - protein, 8 aa, Human papillomavirus type 16
APSLIPIV

SEQ ID NO: 1587 - protein, 8 aa, Human papillomavirus type 16
LRKRRKRL

SEQ ID NO: 1588 - protein, 8 aa, Human papillomavirus type 16
KRRKRLPY

SEQ ID NO: 1589 - protein, 8 aa, Human papillomavirus type 16
RRKRLPYF

SEQ ID NO: 1590 - protein, 8 aa, Human papillomavirus type 16
KRLPYFFS

SEQ ID NO: 1591 - protein, 8 aa, Human papillomavirus type 16
LPYFFSDV

SEQ ID NO: 1592 - protein, 9 aa, Human papillomavirus type 16
MRHKRSAKR

SEQ ID NO: 1593 - protein, 9 aa, Human papillomavirus type 16
KRSAKRTKR

SEQ ID NO: 1594 - protein, 9 aa, Human papillomavirus type 16
KRTKRASAT

SEQ ID NO: 1595 - protein, 9 aa, Human papillomavirus type 16
KRASATQLY

SEQ ID NO: 1596 - protein, 9 aa, Human papillomavirus type 16
QAGTCPPDI

SEQ ID NO: 1597 - protein, 9 aa, Human papillomavirus type 16
CPPDIIPKV

SEQ ID NO: 1598 - protein, 9 aa, Human papillomavirus type 16
IPKVEGKTI

SEQ ID NO: 1599 - protein, 9 aa, Human papillomavirus type 16
ILQYGSMGV

SEQ ID NO: 1600 - protein, 9 aa, Human papillomavirus type 16
LQYGSMGVF

SEQ ID NO: 1601 - protein, 9 aa, Human papillomavirus type 16
QYGSMGVFF

SEQ ID NO: 1602 - protein, 9 aa, Human papillomavirus type 16
GTGSGTGGR

SEQ ID NO: 1603 - protein, 9 aa, Human papillomavirus type 16
TRPPTATDT

SEQ ID NO: 1604 - protein, 9 aa, Human papillomavirus type 16
RPPTATDTL

SEQ ID NO: 1605 - protein, 9 aa, Human papillomavirus type 16
TATDTLAPV

SEQ ID NO: 1606 - protein, 9 aa, Human papillomavirus type 16
APVRPPLTV

SEQ ID NO: 1607 - protein, 9 aa, Human papillomavirus type 16
RPPLTVDPV

SEQ ID NO: 1608 - protein, 9 aa, Human papillomavirus type 16
VGPSDPSIV

SEQ ID NO: 1609 - protein, 9 aa, Human papillomavirus type 16
SLVEETSFI

SEQ ID NO: 1610 - protein, 9 aa, Human papillomavirus type 16
GAPTSVPSI

SEQ ID NO: 1611 - protein, 9 aa, Human papillomavirus type 16
AILDINNTV

SEQ ID NO: 1612 - protein, 9 aa, Human papillomavirus type 16
NPTFTDPSV

SEQ ID NO: 1613 - protein, 9 aa, Human papillomavirus type 16
AETGGHFTL

SEQ ID NO: 1614 - protein, 9 aa, Human papillomavirus type 16
TPIPGSRPV

SEQ ID NO: 1615 - protein, 9 aa, Human papillomavirus type 16
SRPVARLGL

SEQ ID NO: 1616 - protein, 9 aa, Human papillomavirus type 16
ARLGLYSRT

SEQ ID NO: 1617 - protein, 9 aa, Human papillomavirus type 16
SRTTQQVKV

SEQ ID NO: 1618 - protein, 9 aa, Human papillomavirus type 16
AFVTTPTKL

SEQ ID NO: 1619 - protein, 9 aa, Human papillomavirus type 16
NPAYEGIDV

SEQ ID NO: 1620 - protein, 9 aa, Human papillomavirus type 16
APDPDFLDI

SEQ ID NO: 1621 - protein, 9 aa, Human papillomavirus type 16
HRPALTSRR

SEQ ID NO: 1622 - protein, 9 aa, Human papillomavirus type 16
RRTGIRYSR

SEQ ID NO: 1623 - protein, 9 aa, Human papillomavirus type 16
IRYSRIGNK

SEQ ID NO: 1624 - protein, 9 aa, Human papillomavirus type 16
SRIGNKQTL

SEQ ID NO: 1625 - protein, 9 aa, Human papillomavirus type 16
LRTRSGKSI

SEQ ID NO: 1626 - protein, 9 aa, Human papillomavirus type 16
TRSGKSIGA

SEQ ID NO: 1627 - protein, 9 aa, Human papillomavirus type 16
AKVHYYYDL

SEQ ID NO: 1628 - protein, 9 aa, Human papillomavirus type 16
LQTITPSTY

SEQ ID NO: 1629 - protein, 9 aa, Human papillomavirus type 16
SPTSINNGL

SEQ ID NO: 1630 - protein, 9 aa, Human papillomavirus type 16
LYDIYADDF

SEQ ID NO: 1631 - protein, 9 aa, Human papillomavirus type 16
YDIYADDFI

SEQ ID NO: 1632 - protein, 9 aa, Human papillomavirus type 16
VPSVPSTSL

SEQ ID NO: 1633 - protein, 9 aa, Human papillomavirus type 16
IPFGGAYNI

SEQ ID NO: 1634 - protein, 9 aa, Human papillomavirus type 16
IPLVSGPDI

SEQ ID NO: 1635 - protein, 9 aa, Human papillomavirus type 16
QAPSLIPIV

SEQ ID NO: 1636 - protein, 9 aa, Human papillomavirus type 16
VPGSPQYTI

SEQ ID NO: 1637 - protein, 9 aa, Human papillomavirus type 16
FYLHPSYYM

SEQ ID NO: 1638 - protein, 9 aa, Human papillomavirus type 16
YLHPSYYML

SEQ ID NO: 1639 - protein, 9 aa, Human papillomavirus type 16
MLRKRRKRL

SEQ ID NO: 1640 - protein, 9 aa, Human papillomavirus type 16
KRRKRLPYF

SEQ ID NO: 1641 - protein, 9 aa, Human papillomavirus type 16
RRKRLPYFF

SEQ ID NO: 1642 - protein, 9 aa, Human papillomavirus type 16
RLPYFFSDV

SEQ ID NO: 1643 - protein, 10 aa, Human papillomavirus type 16
KRSAKRTKRA

SEQ ID NO: 1644 - protein, 10 aa, Human papillomavirus type 16
KRASATQLYK

SEQ ID NO: 1645 - protein, 10 aa, Human papillomavirus type 16
KQAGTCPPDI

SEQ ID NO: 1646 - protein, 10 aa, Human papillomavirus type 16
QAGTCPPDII

SEQ ID NO: 1647 - protein, 10 aa, Human papillomavirus type 16
LQYGSMGVFF

SEQ ID NO: 1648 - protein, 10 aa, Human papillomavirus type 16
GSMGVFFGGL

SEQ ID NO: 1649 - protein, 10 aa, Human papillomavirus type 16
MGVFFGGLGI

SEQ ID NO: 1650 - protein, 10 aa, Human papillomavirus type 16
SGTGGRTGYI

SEQ ID NO: 1651 - protein, 10 aa, Human papillomavirus type 16
GRTGYIPLGT

SEQ ID NO: 1652 - protein, 10 aa, Human papillomavirus type 16
RTGYIPLGTR

SEQ ID NO: 1653 - protein, 10 aa, Human papillomavirus type 16
TRPPTATDTL

SEQ ID NO: 1654 - protein, 10 aa, Human papillomavirus type 16
LAPVRPPLTV

SEQ ID NO: 1655 - protein, 10 aa, Human papillomavirus type 16
VRPPLTVDPV

SEQ ID NO: 1656 - protein, 10 aa, Human papillomavirus type 16
DPVGPSDPSI

SEQ ID NO: 1657 - protein, 10 aa, Human papillomavirus type 16
GPSDPSIVSL

SEQ ID NO: 1658 - protein, 10 aa, Human papillomavirus type 16
IPPDVSGFSI

SEQ ID NO: 1659 - protein, 10 aa, Human papillomavirus type 16
NPTFTDPSVL

SEQ ID NO: 1660 - protein, 10 aa, Human papillomavirus type 16
NYEEIPMDTF

SEQ ID NO: 1661 - protein, 10 aa, Human papillomavirus type 16
IPGSRPVARL

SEQ ID NO: 1662 - protein, 10 aa, Human papillomavirus type 16
SRPVARLGLY

SEQ ID NO: 1663 - protein, 10 aa, Human papillomavirus type 16
GLYSRTTQQV

SEQ ID NO: 1664 - protein, 10 aa, Human papillomavirus type 16
SRTTQQVKVV

SEQ ID NO: 1665 - protein, 10 aa, Human papillomavirus type 16
QQVKVVDPAF

SEQ ID NO: 1666 - protein, 10 aa, Human papillomavirus type 16
YEGIDVDNTL

SEQ ID NO: 1667 - protein, 10 aa, Human papillomavirus type 16
IAPDPDFLDI

SEQ ID NO: 1668 - protein, 10 aa, Human papillomavirus type 16
APDPDFLDIV

SEQ ID NO: 1669 - protein, 10 aa, Human papillomavirus type 16
DPDFLDIVAL

SEQ ID NO: 1670 - protein, 10 aa, Human papillomavirus type 16
DIVALHRPAL

SEQ ID NO: 1671 - protein, 10 aa, Human papillomavirus type 16
SRRTGIRYSR

SEQ ID NO: 1672 - protein, 10 aa, Human papillomavirus type 16
RRTGIRYSRI

SEQ ID NO: 1673 - protein, 10 aa, Human papillomavirus type 16
IRYSRIGNKQ

SEQ ID NO: 1674 - protein, 10 aa, Human papillomavirus type 16
SRIGNKQTLR

SEQ ID NO: 1675 - protein, 10 aa, Human papillomavirus type 16
KQTLRTRSGK

SEQ ID NO: 1676 - protein, 10 aa, Human papillomavirus type 16
TRSGKSIGAK

SEQ ID NO: 1677 - protein, 10 aa, Human papillomavirus type 16
VPSTSLSGYI

SEQ ID NO: 1678 - protein, 10 aa, Human papillomavirus type 16
SGYIPANTTI

SEQ ID NO: 1679 - protein, 10 aa, Human papillomavirus type 16
DQAPSLIPIV

SEQ ID NO: 1680 - protein, 10 aa, Human papillomavirus type 16
VPGSPQYTII

SEQ ID NO: 1681 - protein, 10 aa, Human papillomavirus type 16
IIADAGDFYL

SEQ ID NO: 1682 - protein, 10 aa, Human papillomavirus type 16
DFYLHPSYYM

SEQ ID NO: 1683 - protein, 10 aa, Human papillomavirus type 16
FYLHPSYYML

SEQ ID NO: 1684 - protein, 10 aa, Human papillomavirus type 16
YMLRKRRKRL

SEQ ID NO: 1685 - protein, 10 aa, Human papillomavirus type 16
LRKRRKRLPY

SEQ ID NO: 1686 - protein, 10 aa, Human papillomavirus type 16
KRRKRLPYFF

SEQ ID NO: 1687 - protein, 10 aa, Human papillomavirus type 16
RRKRLPYFFS

SEQ ID NO: 1688 - protein, 10 aa, Human papillomavirus type 16
KRLPYFFSDV

SEQ ID NO: 1689 - protein, 10 aa, Human papillomavirus type 16
LPYFFSDVSL

SEQ ID NO: 1690 - protein, 8 aa, Human papillomavirus type 16
YGLQTNTI

SEQ ID NO: 1691 - protein, 8 aa, Human papillomavirus type 16
LQTNTIVF

SEQ ID NO: 1692 - protein, 8 aa, Human papillomavirus type 16
YRGTLGQR

SEQ ID NO: 1693 - protein, 8 aa, Human papillomavirus type 16
RGTLGQRI

SEQ ID NO: 1694 - protein, 9 aa, Human papillomavirus type 16
YGLQTNTIV

SEQ ID NO: 1695 - protein, 9 aa, Human papillomavirus type 16
QTNTIVFNW

SEQ ID NO: 1696 - protein, 9 aa, Human papillomavirus type 16
LQTTYRGTL

SEQ ID NO: 1697 - protein, 9 aa, Human papillomavirus type 16
YRGTLGQRI

SEQ ID NO: 1698 - protein, 8 aa, Human papillomavirus type 16
MRQRLTYR

SEQ ID NO: 1699 - protein, 9 aa, Human papillomavirus type 16
MRQRLTYRC

SEQ ID NO: 1700 - protein, 8 aa, Human papillomavirus type 16
LQCFRTHR

SEQ ID NO: 1701 - protein, 8 aa, Human papillomavirus type 16
HRSDPESY

SEQ ID NO: 1702 - protein, 8 aa, Human papillomavirus type 16
YAQSCKQL

SEQ ID NO: 1703 - protein, 8 aa, Human papillomavirus type 16
AQSCKQLY

SEQ ID NO: 1704 - protein, 9 aa, Human papillomavirus type 16
HRSDPESYH

SEQ ID NO: 1705 - protein, 9 aa, Human papillomavirus type 16
SYAQSCKQL

SEQ ID NO: 1706 - protein, 10 aa, Human papillomavirus type 16
FRTHRSDPES

SEQ ID NO: 1707 - protein, 10 aa, Human papillomavirus type 16
HRSDPESYHS

SEQ ID NO: 1708 - protein, 10 aa, Human papillomavirus type 16
RSDPESYHSY

SEQ ID NO: 1709 - protein, 8 aa, Human papillomavirus type 16
LRSTAAAL

SEQ ID NO: 1710 - protein, 8 aa, Human papillomavirus type 16
QRQTVLQH

SEQ ID NO: 1711 - protein, 8 aa, Human papillomavirus type 16
SQMVQWAY

SEQ ID NO: 1712 - protein, 8 aa, Human papillomavirus type 16
WAYDNDIV

SEQ ID NO: 1713 - protein, 8 aa, Human papillomavirus type 16
IAYKYAQL

SEQ ID NO: 1714 - protein, 8 aa, Human papillomavirus type 16
KRAEKKQM

SEQ ID NO: 1715 - protein, 8 aa, Human papillomavirus type 16
KQIVMFLR

SEQ ID NO: 1716 - protein, 8 aa, Human papillomavirus type 16
LRYQGVEF

SEQ ID NO: 1717 - protein, 8 aa, Human papillomavirus type 16
KRFLQGIP

SEQ ID NO: 1718 - protein, 8 aa, Human papillomavirus type 16
LQGSVICF

SEQ ID NO: 1719 - protein, 8 aa, Human papillomavirus type 16
SHFWLQPL

SEQ ID NO: 1720 - protein, 8 aa, Human papillomavirus type 16
LQPLADAK

SEQ ID NO: 1721 - protein, 8 aa, Human papillomavirus type 16
QPLADAKI

SEQ ID NO: 1722 - protein, 8 aa, Human papillomavirus type 16
WNYIDDNL

SEQ ID NO: 1723 - protein, 8 aa, Human papillomavirus type 16
LRNALDGN

SEQ ID NO: 1724 - protein, 8 aa, Human papillomavirus type 16
NALDGNLV

SEQ ID NO: 1725 - protein, 8 aa, Human papillomavirus type 16
HRPLVQLK

SEQ ID NO: 1726 - protein, 8 aa, Human papillomavirus type 16
VQLKCPPL

SEQ ID NO: 1727 - protein, 8 aa, Human papillomavirus type 16
SRWPYLHN

SEQ ID NO: 1728 - protein, 8 aa, Human papillomavirus type 16
WPYLHNRL

SEQ ID NO: 1729 - protein, 8 aa, Human papillomavirus type 16
NRLVVFTF

SEQ ID NO: 1730 - protein, 8 aa, Human papillomavirus type 16
SRTWSRLS

SEQ ID NO: 1731 - protein, 8 aa, Human papillomavirus type 16
RTWSRLSL

SEQ ID NO: 1732 - protein, 9 aa, Human papillomavirus type 16
LRSTAAALY

SEQ ID NO: 1733 - protein, 9 aa, Human papillomavirus type 16
RSTAAALYW

SEQ ID NO: 1734 - protein, 9 aa, Human papillomavirus type 16
TGISNISEV

SEQ ID NO: 1735 - protein, 9 aa, Human papillomavirus type 16
QRQTVLQHS

SEQ ID NO: 1736 - protein, 9 aa, Human papillomavirus type 16
RQTVLQHSF

SEQ ID NO: 1737 - protein, 9 aa, Human papillomavirus type 16
SFNDCTFEL

SEQ ID NO: 1738 - protein, 9 aa, Human papillomavirus type 16
VQWAYDNDI

SEQ ID NO: 1739 - protein, 9 aa, Human papillomavirus type 16
IVDDSEIAY

SEQ ID NO: 1740 - protein, 9 aa, Human papillomavirus type 16
ATMCRHYKR

SEQ ID NO: 1741 - protein, 9 aa, Human papillomavirus type 16
CRHYKRAEK

SEQ ID NO: 1742 - protein, 9 aa, Human papillomavirus type 16
KRAEKKQMS

SEQ ID NO: 1743 - protein, 9 aa, Human papillomavirus type 16
KQMSMSQWI

SEQ ID NO: 1744 - protein, 9 aa, Human papillomavirus type 16
RVDDGGDWK

SEQ ID NO: 1745 - protein, 9 aa, Human papillomavirus type 16
KQIVMFLRY

SEQ ID NO: 1746 - protein, 9 aa, Human papillomavirus type 16
VMFLRYQGV

SEQ ID NO: 1747 - protein, 9 aa, Human papillomavirus type 16
FLRYQGVEF

SEQ ID NO: 1748 - protein, 9 aa, Human papillomavirus type 16
LRYQGVEFM

SEQ ID NO: 1749 - protein, 9 aa, Human papillomavirus type 16
YQGVEFMSF

SEQ ID NO: 1750 - protein, 9 aa, Human papillomavirus type 16
EFMSFLTAL

SEQ ID NO: 1751 - protein, 9 aa, Human papillomavirus type 16
SFLTALKRF

SEQ ID NO: 1752 - protein, 9 aa, Human papillomavirus type 16
FLTALKRFL

SEQ ID NO: 1753 - protein, 9 aa, Human papillomavirus type 16
KRFLQGIPK

SEQ ID NO: 1754 - protein, 9 aa, Human papillomavirus type 16
QGIPKKNCI

SEQ ID NO: 1755 - protein, 9 aa, Human papillomavirus type 16
SLFGMSLMK

SEQ ID NO: 1756 - protein, 9 aa, Human papillomavirus type 16
LFGMSLMKF

SEQ ID NO: 1757 - protein, 9 aa, Human papillomavirus type 16
LQGSVICFV

SEQ ID NO: 1758 - protein, 9 aa, Human papillomavirus type 16
SVICFVNSK

SEQ ID NO: 1759 - protein, 9 aa, Human papillomavirus type 16
CFVNSKSHF

SEQ ID NO: 1760 - protein, 9 aa, Human papillomavirus type 16
LRNALDGNL

SEQ ID NO: 1761 - protein, 9 aa, Human papillomavirus type 16
LVSMDVKHR

SEQ ID NO: 1762 - protein, 9 aa, Human papillomavirus type 16
HRPLVQLKC

SEQ ID NO: 1763 - protein, 9 aa, Human papillomavirus type 16
VQLKCPPLL

SEQ ID NO: 1764 - protein, 9 aa, Human papillomavirus type 16
PPLLITSNI

SEQ ID NO: 1765 - protein, 9 aa, Human papillomavirus type 16
SRWPYLHNR

SEQ ID NO: 1766 - protein, 9 aa, Human papillomavirus type 16
WPYLHNRLV

SEQ ID NO: 1767 - protein, 9 aa, Human papillomavirus type 16
KNWKSFFSR

SEQ ID NO: 1768 - protein, 9 aa, Human papillomavirus type 16
FFSRTWSRL

SEQ ID NO: 1769 - protein, 9 aa, Human papillomavirus type 16
SRTWSRLSL

SEQ ID NO: 1770 - protein, 10 aa, Human papillomavirus type 16
KLRSTAAALY

SEQ ID NO: 1771 - protein, 10 aa, Human papillomavirus type 16
LRSTAAALYW

SEQ ID NO: 1772 - protein, 10 aa, Human papillomavirus type 16
AALYWYKTGI

SEQ ID NO: 1773 - protein, 10 aa, Human papillomavirus type 16
TPEWIQRQTV

SEQ ID NO: 1774 - protein, 10 aa, Human papillomavirus type 16
QRQTVLQHSF

SEQ ID NO: 1775 - protein, 10 aa, Human papillomavirus type 16
LQHSFNDCTF

SEQ ID NO: 1776 - protein, 10 aa, Human papillomavirus type 16
VQWAYDNDIV

SEQ ID NO: 1777 - protein, 10 aa, Human papillomavirus type 16
IVDDSEIAYK

SEQ ID NO: 1778 - protein, 10 aa, Human papillomavirus type 16
SEIAYKYAQL

SEQ ID NO: 1779 - protein, 10 aa, Human papillomavirus type 16
IVKDCATMCR

SEQ ID NO: 1780 - protein, 10 aa, Human papillomavirus type 16
CRHYKRAEKK

SEQ ID NO: 1781 - protein, 10 aa, Human papillomavirus type 16
HYKRAEKKQM

SEQ ID NO: 1782 - protein, 10 aa, Human papillomavirus type 16
KRAEKKQMSM

SEQ ID NO: 1783 - protein, 10 aa, Human papillomavirus type 16
KQMSMSQWIK

SEQ ID NO: 1784 - protein, 10 aa, Human papillomavirus type 16
SQWIKYRCDR

SEQ ID NO: 1785 - protein, 10 aa, Human papillomavirus type 16
DRVDDGGDWK

SEQ ID NO: 1786 - protein, 10 aa, Human papillomavirus type 16
GDWKQIVMFL

SEQ ID NO: 1787 - protein, 10 aa, Human papillomavirus type 16
MFLRYQGVEF

SEQ ID NO: 1788 - protein, 10 aa, Human papillomavirus type 16
LRYQGVEFMS

SEQ ID NO: 1789 - protein, 10 aa, Human papillomavirus type 16
RYQGVEFMSF

SEQ ID NO: 1790 - protein, 10 aa, Human papillomavirus type 16
YQGVEFMSFL

SEQ ID NO: 1791 - protein, 10 aa, Human papillomavirus type 16
VEFMSFLTAL

SEQ ID NO: 1792 - protein, 10 aa, Human papillomavirus type 16
SFLTALKRFL

SEQ ID NO: 1793 - protein, 10 aa, Human papillomavirus type 16
TALKRFLQGI

SEQ ID NO: 1794 - protein, 10 aa, Human papillomavirus type 16
KRFLQGIPKK

SEQ ID NO: 1795 - protein, 10 aa, Human papillomavirus type 16
QGIPKKNCIL

SEQ ID NO: 1796 - protein, 10 aa, Human papillomavirus type 16
IPKKNCILLY

SEQ ID NO: 1797 - protein, 10 aa, Human papillomavirus type 16
LLYGAANTGK

SEQ ID NO: 1798 - protein, 10 aa, Human papillomavirus type 16
LFGMSLMKFL

SEQ ID NO: 1799 - protein, 10 aa, Human papillomavirus type 16
KFLQGSVICF

SEQ ID NO: 1800 - protein, 10 aa, Human papillomavirus type 16
FLQGSVICFV

SEQ ID NO: 1801 - protein, 10 aa, Human papillomavirus type 16
FVNSKSHFWL

SEQ ID NO: 1802 - protein, 10 aa, Human papillomavirus type 16
DATVPCWNYI

SEQ ID NO: 1803 - protein, 10 aa, Human papillomavirus type 16
LRNALDGNLV

SEQ ID NO: 1804 - protein, 10 aa, Human papillomavirus type 16
CPPLLITSNI

SEQ ID NO: 1805 - protein, 10 aa, Human papillomavirus type 16
SRWPYLHNRL

SEQ ID NO: 1806 - protein, 10 aa, Human papillomavirus type 16
WPYLHNRLVV

SEQ ID NO: 1807 - protein, 10 aa, Human papillomavirus type 16
YLHNRLVVFT

SEQ ID NO: 1808 - protein, 10 aa, Human papillomavirus type 16
NRLVVFTFPN

SEQ ID NO: 1809 - protein, 10 aa, Human papillomavirus type 16
VFTFPNEFPF

SEQ ID NO: 1810 - protein, 10 aa, Human papillomavirus type 16
FPFDENGNPV

SEQ ID NO: 1811 - protein, 10 aa, Human papillomavirus type 16
DENGNPVYEL

SEQ ID NO: 1812 - protein, 10 aa, Human papillomavirus type 16
SFFSRTWSRL

SEQ ID NO: 1813 - protein, 10 aa, Human papillomavirus type 16
SRTWSRLSLH

SEQ ID NO: 1814 - protein, 9 aa, Human papillomavirus type 16
LACFLLCFV

SEQ ID NO: 1815 - protein, 9 aa, Human papillomavirus type 16
CFLLCFVCF

SEQ ID NO: 1816 - protein, 9 aa, Human papillomavirus type 16
FLLCFVCFC

SEQ ID NO: 1817 - protein, 9 aa, Human papillomavirus type 16
LLCFVCFCV

SEQ ID NO: 1818 - protein, 10 aa, Human papillomavirus type 16
FLLCFVCFCV

SEQ ID NO: 1819 - protein, 8 aa, Human papillomavirus type 16
LRLGVLLY

SEQ ID NO: 1820 - protein, 9 aa, Human papillomavirus type 16
LRLGVLLYI

SEQ ID NO: 1821 - protein, 9 aa, Human papillomavirus type 16
GVLLYILYL

SEQ ID NO: 1822 - protein, 9 aa, Human papillomavirus type 16
LLYILYLFI

SEQ ID NO: 1823 - protein, 9 aa, Human papillomavirus type 16
ILYLFIYHY

SEQ ID NO: 1824 - protein, 9 aa, Human papillomavirus type 16
LYLFIYHYF

SEQ ID NO: 1825 - protein, 10 aa, Human papillomavirus type 16
LRLGVLLYIL

SEQ ID NO: 1826 - protein, 10 aa, Human papillomavirus type 16
RLGVLLYILY

SEQ ID NO: 1827 - protein, 10 aa, Human papillomavirus type 16
VLLYILYLFI

SEQ ID NO: 1828 - protein, 10 aa, Human papillomavirus type 16
LLYILYLFIY

SEQ ID NO: 1829 - protein, 10 aa, Human papillomavirus type 16
ILYLFIYHYF

SEQ ID NO: 1830 - protein, 8 aa, Human papillomavirus type 16
HRLPNFIK

SEQ ID NO: 1831 - protein, 8 aa, Human papillomavirus type 16
HANRQVHV

SEQ ID NO: 1832 - protein, 8 aa, Human papillomavirus type 16
NRQVHVHL

SEQ ID NO: 1833 - protein, 8 aa, Human papillomavirus type 16
YLRLKAKL

SEQ ID NO: 1834 - protein, 8 aa, Human papillomavirus type 16
LRLKAKLL

SEQ ID NO: 1835 - protein, 9 aa, Human papillomavirus type 16
LQNAQNVHR

SEQ ID NO: 1836 - protein, 9 aa, Human papillomavirus type 16
HRLPNFIKH

SEQ ID NO: 1837 - protein, 9 aa, Human papillomavirus type 16
ANRQVHVHL

SEQ ID NO: 1838 - protein, 9 aa, Human papillomavirus type 16
NRQVHVHLT

SEQ ID NO: 1839 - protein, 9 aa, Human papillomavirus type 16
RQVHVHLTL

SEQ ID NO: 1840 - protein, 9 aa, Human papillomavirus type 16
VHVHLTLYL

SEQ ID NO: 1841 - protein, 9 aa, Human papillomavirus type 16
HVHLTLYLR

SEQ ID NO: 1842 - protein, 9 aa, Human papillomavirus type 16
VHLTLYLRL

SEQ ID NO: 1843 - protein, 9 aa, Human papillomavirus type 16
LYLRLKAKL

SEQ ID NO: 1844 - protein, 9 aa, Human papillomavirus type 16
YLRLKAKLL

SEQ ID NO: 1845 - protein, 9 aa, Human papillomavirus type 16
LRLKAKLLL

SEQ ID NO: 1846 - protein, 10 aa, Human papillomavirus type 16
LQNAQNVHRL

SEQ ID NO: 1847 - protein, 10 aa, Human papillomavirus type 16
AQNVHRLPNF

SEQ ID NO: 1848 - protein, 10 aa, Human papillomavirus type 16
NVHRLPNFIK

SEQ ID NO: 1849 - protein, 10 aa, Human papillomavirus type 16
NRQVHVHLTL

SEQ ID NO: 1850 - protein, 10 aa, Human papillomavirus type 16
RQVHVHLTLY

SEQ ID NO: 1851 - protein, 10 aa, Human papillomavirus type 16
TLYLRLKAKL

SEQ ID NO: 1852 - protein, 10 aa, Human papillomavirus type 16
LYLRLKAKLL

SEQ ID NO: 1853 - protein, 10 aa, Human papillomavirus type 16
LRLKAKLLLN

SEQ ID NO: 1854 - protein, 10 aa, Human papillomavirus type 16
LLNKYYNMEV

SEQ ID NO: 1855 - protein, 10 aa, Human papillomavirus type 16
YYNMEVWVYF

SEQ ID NO: 1856 - protein, 10 aa, Human papillomavirus type 16
YNMEVWVYFL

SEQ ID NO: 1857 - protein, 8 aa, Human papillomavirus type 16
QGLPQLQI

SEQ ID NO: 1858 - protein, 8 aa, Human papillomavirus type 16
LPQLQIHL

SEQ ID NO: 1859 - protein, 9 aa, Human papillomavirus type 16
LPQLQIHLL

SEQ ID NO: 1860 - protein, 10 aa, Human papillomavirus type 16
FHWEQGLPQL

SEQ ID NO: 1861 - protein, 10 aa, Human papillomavirus type 16
QGLPQLQIHL

SEQ ID NO: 1862 - protein, 10 aa, Human papillomavirus type 16
LPQLQIHLLL

SEQ ID NO: 1863 - protein, 8 aa, Human papillomavirus type 16
HQHLYLPF

SEQ ID NO: 1864 - protein, 8 aa, Human papillomavirus type 16
FPQMYQDL

SEQ ID NO: 1865 - protein, 8 aa, Human papillomavirus type 16
QMYQDLVL

SEQ ID NO: 1866 - protein, 8 aa, Human papillomavirus type 16
YQDLVLLL

SEQ ID NO: 1867 - protein, 8 aa, Human papillomavirus type 16
LQLIPHLL

SEQ ID NO: 1868 - protein, 9 aa, Human papillomavirus type 16
FPQMYQDLV

SEQ ID NO: 1869 - protein, 9 aa, Human papillomavirus type 16
QMYQDLVLL

SEQ ID NO: 1870 - protein, 9 aa, Human papillomavirus type 16
MYQDLVLLL

SEQ ID NO: 1871 - protein, 9 aa, Human papillomavirus type 16
LLLQLIPHL

SEQ ID NO: 1872 - protein, 9 aa, Human papillomavirus type 16
LQLIPHLLY

SEQ ID NO: 1873 - protein, 10 aa, Human papillomavirus type 16
LPFPQMYQDL

SEQ ID NO: 1874 - protein, 10 aa, Human papillomavirus type 16
FPQMYQDLVL

SEQ ID NO: 1875 - protein, 10 aa, Human papillomavirus type 16
QMYQDLVLLL

SEQ ID NO: 1876 - protein, 10 aa, Human papillomavirus type 16
YQDLVLLLQL

SEQ ID NO: 1877 - protein, 10 aa, Human papillomavirus type 16
QDLVLLLQLI

SEQ ID NO: 1878 - protein, 10 aa, Human papillomavirus type 16
VLLLQLIPHL

SEQ ID NO: 1879 - protein, 10 aa, Human papillomavirus type 16
LLLQLIPHLL

SEQ ID NO: 1880 - protein, 8 aa, Human papillomavirus type 16
IPLSLTHL

SEQ ID NO: 1881 - protein, 8 aa, Human papillomavirus type 16
LQKLEGIL

SEQ ID NO: 1882 - protein, 8 aa, Human papillomavirus type 16
LHFHHPLL

SEQ ID NO: 1883 - protein, 8 aa, Human papillomavirus type 16
HPLLVHII

SEQ ID NO: 1884 - protein, 8 aa, Human papillomavirus type 16
FLWIHLLL

SEQ ID NO: 1885 - protein, 9 aa, Human papillomavirus type 16
LLLHIIIPL

SEQ ID NO: 1886 - protein, 9 aa, Human papillomavirus type 16
LHIIIPLSL

SEQ ID NO: 1887 - protein, 9 aa, Human papillomavirus type 16
HLYCSLQHL

SEQ ID NO: 1888 - protein, 9 aa, Human papillomavirus type 16
HPLLVHIIM

SEQ ID NO: 1889 - protein, 9 aa, Human papillomavirus type 16
LLVHIIMKK

SEQ ID NO: 1890 - protein, 9 aa, Human papillomavirus type 16
KFLWIHLLL

SEQ ID NO: 1891 - protein, 9 aa, Human papillomavirus type 16
FLWIHLLLA

SEQ ID NO: 1892 - protein, 9 aa, Human papillomavirus type 16
IHLLLAQTL

SEQ ID NO: 1893 - protein, 10 aa, Human papillomavirus type 16
LLLLHIIIPL

SEQ ID NO: 1894 - protein, 10 aa, Human papillomavirus type 16
IIIPLSLTHL

SEQ ID NO: 1895 - protein, 10 aa, Human papillomavirus type 16
LSLTHLYCSL

SEQ ID NO: 1896 - protein, 10 aa, Human papillomavirus type 16
THLYCSLQHL

SEQ ID NO: 1897 - protein, 10 aa, Human papillomavirus type 16
LQKLEGILHF

SEQ ID NO: 1898 - protein, 10 aa, Human papillomavirus type 16
ILHFHHPLLV

SEQ ID NO: 1899 - protein, 8 aa, Human papillomavirus type 16
LALGTVEL

SEQ ID NO: 1900 - protein, 9 aa, Human papillomavirus type 16
LALGTVELV

SEQ ID NO: 1901 - protein, 9 aa, Human papillomavirus type 16
HYVLVVENL

SEQ ID NO: 1902 - protein, 10 aa, Human papillomavirus type 16
LALGTVELVI

SEQ ID NO: 1903 - protein, 10 aa, Human papillomavirus type 16
KHYVLVVENL

SEQ ID NO: 1904 - protein, 8 aa, Human papillomavirus type 16
YPLHLYQV

SEQ ID NO: 1905 - protein, 8 aa, Human papillomavirus type 16
HLYQVIFL

SEQ ID NO: 1906 - protein, 8 aa, Human papillomavirus type 16
LQIQQFLL

SEQ ID NO: 1907 - protein, 8 aa, Human papillomavirus type 16
QQFLLVVH

SEQ ID NO: 1908 - protein, 9 aa, Human papillomavirus type 16
YPLHLYQVI

SEQ ID NO: 1909 - protein, 9 aa, Human papillomavirus type 16
LHLYQVIFL

SEQ ID NO: 1910 - protein, 9 aa, Human papillomavirus type 16
LYQVIFLQI

SEQ ID NO: 1911 - protein, 9 aa, Human papillomavirus type 16
IFLQIQQFL

SEQ ID NO: 1912 - protein, 9 aa, Human papillomavirus type 16
FLQIQQFLL

SEQ ID NO: 1913 - protein, 9 aa, Human papillomavirus type 16
QQFLLVVHT

SEQ ID NO: 1914 - protein, 9 aa, Human papillomavirus type 16
LLVVHTIFL

SEQ ID NO: 1915 - protein, 10 aa, Human papillomavirus type 16
LYPLHLYQVI

SEQ ID NO: 1916 - protein, 10 aa, Human papillomavirus type 16
VIFLQIQQFL

SEQ ID NO: 1917 - protein, 10 aa, Human papillomavirus type 16
IFLQIQQFLL

SEQ ID NO: 1918 - protein, 10 aa, Human papillomavirus type 16
FLQIQQFLLV

SEQ ID NO: 1919 - protein, 10 aa, Human papillomavirus type 16
LQIQQFLLVV

SEQ ID NO: 1920 - protein, 10 aa, Human papillomavirus type 16
QQFLLVVHTI

SEQ ID NO: 1921 - protein, 10 aa, Human papillomavirus type 16
QFLLVVHTIF

SEQ ID NO: 1922 - protein, 10 aa, Human papillomavirus type 16
FLLVVHTIFL

SEQ ID NO: 1923 - protein, 8 aa, Human papillomavirus type 16
ARTNIYYH

SEQ ID NO: 1924 - protein, 8 aa, Human papillomavirus type 16
SRLLAVGH

SEQ ID NO: 1925 - protein, 8 aa, Human papillomavirus type 16
KPNNNKIL

SEQ ID NO: 1926 - protein, 8 aa, Human papillomavirus type 16
LQYRVFRI

SEQ ID NO: 1927 - protein, 8 aa, Human papillomavirus type 16
YRVFRIHL

SEQ ID NO: 1928 - protein, 8 aa, Human papillomavirus type 16
NPDTQRLV

SEQ ID NO: 1929 - protein, 8 aa, Human papillomavirus type 16
QRLVWACV

SEQ ID NO: 1930 - protein, 8 aa, Human papillomavirus type 16
WACVGVEV

SEQ ID NO: 1931 - protein, 8 aa, Human papillomavirus type 16
GRGQPLGV

SEQ ID NO: 1932 - protein, 8 aa, Human papillomavirus type 16
KQTQLCLI

SEQ ID NO: 1933 - protein, 8 aa, Human papillomavirus type 16
SPCTNVAV

SEQ ID NO: 1934 - protein, 8 aa, Human papillomavirus type 16
NPGDCPPL

SEQ ID NO: 1935 - protein, 8 aa, Human papillomavirus type 16
YPDYIKMV

SEQ ID NO: 1936 - protein, 8 aa, Human papillomavirus type 16
LRREQMFV

SEQ ID NO: 1937 - protein, 8 aa, Human papillomavirus type 16
RREQMFVR

SEQ ID NO: 1938 - protein, 8 aa, Human papillomavirus type 16
QMFVRHLF

SEQ ID NO: 1939 - protein, 8 aa, Human papillomavirus type 16
AQIFNKPY

SEQ ID NO: 1940 - protein, 8 aa, Human papillomavirus type 16
QRAQGHNN

SEQ ID NO: 1941 - protein, 8 aa, Human papillomavirus type 16
TRSTNMSL

SEQ ID NO: 1942 - protein, 8 aa, Human papillomavirus type 16
RHGEEYDL

SEQ ID NO: 1943 - protein, 8 aa, Human papillomavirus type 16
LQFIFQLC

SEQ ID NO: 1944 - protein, 8 aa, Human papillomavirus type 16
FQLCKITL

SEQ ID NO: 1945 - protein, 8 aa, Human papillomavirus type 16
TADVMTYI

SEQ ID NO: 1946 - protein, 8 aa, Human papillomavirus type 16
QPPPGGTL

SEQ ID NO: 1947 - protein, 8 aa, Human papillomavirus type 16
YRFVTQAI

SEQ ID NO: 1948 - protein, 8 aa, Human papillomavirus type 16
TQAIACQK

SEQ ID NO: 1949 - protein, 8 aa, Human papillomavirus type 16
APKEDDPL

SEQ ID NO: 1950 - protein, 8 aa, Human papillomavirus type 16
FPLGRKFL

SEQ ID NO: 1951 - protein, 8 aa, Human papillomavirus type 16
GRKFLLQA

SEQ ID NO: 1952 - protein, 8 aa, Human papillomavirus type 16
LQAGLKAK

SEQ ID NO: 1953 - protein, 8 aa, Human papillomavirus type 16
KAKPKFTL

SEQ ID NO: 1954 - protein, 8 aa, Human papillomavirus type 16
KRKATPTT

SEQ ID NO: 1955 - protein, 9 aa, Human papillomavirus type 16
LMQVTFIYI

SEQ ID NO: 1956 - protein, 9 aa, Human papillomavirus type 16
MQVTFIYIL

SEQ ID NO: 1957 - protein, 9 aa, Human papillomavirus type 16
YHIFFQMSL

SEQ ID NO: 1958 - protein, 9 aa, Human papillomavirus type 16
IFFQMSLWL

SEQ ID NO: 1959 - protein, 9 aa, Human papillomavirus type 16
LPSEATVYL

SEQ ID NO: 1960 - protein, 9 aa, Human papillomavirus type 16
EATVYLPPV

SEQ ID NO: 1961 - protein, 9 aa, Human papillomavirus type 16
LPPVPVSKV

SEQ ID NO: 1962 - protein, 9 aa, Human papillomavirus type 16
ARTNIYYHA

SEQ ID NO: 1963 - protein, 9 aa, Human papillomavirus type 16
YYHAGTSRL

SEQ ID NO: 1964 - protein, 9 aa, Human papillomavirus type 16
KPNNNKILV

SEQ ID NO: 1965 - protein, 9 aa, Human papillomavirus type 16
ILVPKVSGL

SEQ ID NO: 1966 - protein, 9 aa, Human papillomavirus type 16
VPKVSGLQY

SEQ ID NO: 1967 - protein, 9 aa, Human papillomavirus type 16
GLQYRVFRI

SEQ ID NO: 1968 - protein, 9 aa, Human papillomavirus type 16
QYRVFRIHL

SEQ ID NO: 1969 - protein, 9 aa, Human papillomavirus type 16
FRIHLPDPN

SEQ ID NO: 1970 - protein, 9 aa, Human papillomavirus type 16
KFGFPDTSF

SEQ ID NO: 1971 - protein, 9 aa, Human papillomavirus type 16
FYNPDTQRL

SEQ ID NO: 1972 - protein, 9 aa, Human papillomavirus type 16
VEVGRGQPL

SEQ ID NO: 1973 - protein, 9 aa, Human papillomavirus type 16
SAYAANAGV

SEQ ID NO: 1974 - protein, 9 aa, Human papillomavirus type 16
AGVDNRECI

SEQ ID NO: 1975 - protein, 9 aa, Human papillomavirus type 16
NRECISMDY

SEQ ID NO: 1976 - protein, 9 aa, Human papillomavirus type 16
DYKQTQLCL

SEQ ID NO: 1977 - protein, 9 aa, Human papillomavirus type 16
TQLCLIGCK

SEQ ID NO: 1978 - protein, 9 aa, Human papillomavirus type 16
GDCPPLELI

SEQ ID NO: 1979 - protein, 9 aa, Human papillomavirus type 16
VPLDICTSI

SEQ ID NO: 1980 - protein, 9 aa, Human papillomavirus type 16
CKYPDYIKM

SEQ ID NO: 1981 - protein, 9 aa, Human papillomavirus type 16
FFYLRREQM

SEQ ID NO: 1982 - protein, 9 aa, Human papillomavirus type 16
FYLRREQMF

SEQ ID NO: 1983 - protein, 9 aa, Human papillomavirus type 16
YLRREQMFV

SEQ ID NO: 1984 - protein, 9 aa, Human papillomavirus type 16
LRREQMFVR

SEQ ID NO: 1985 - protein, 9 aa, Human papillomavirus type 16
RREQMFVRH

SEQ ID NO: 1986 - protein, 9 aa, Human papillomavirus type 16
REQMFVRHL

SEQ ID NO: 1987 - protein, 9 aa, Human papillomavirus type 16
NRAGTVGEN

SEQ ID NO: 1988 - protein, 9 aa, Human papillomavirus type 16
RAGTVGENV

SEQ ID NO: 1989 - protein, 9 aa, Human papillomavirus type 16
NVPDDLYIK

SEQ ID NO: 1990 - protein, 9 aa, Human papillomavirus type 16
YFPTPSGSM

SEQ ID NO: 1991 - protein, 9 aa, Human papillomavirus type 16
FPTPSGSMV

SEQ ID NO: 1992 - protein, 9 aa, Human papillomavirus type 16
RAQGHNNGI

SEQ ID NO: 1993 - protein, 9 aa, Human papillomavirus type 16
FVTVVDTTR

SEQ ID NO: 1994 - protein, 9 aa, Human papillomavirus type 16
TRSTNMSLC

SEQ ID NO: 1995 - protein, 9 aa, Human papillomavirus type 16
LRHGEEYDL

SEQ ID NO: 1996 - protein, 9 aa, Human papillomavirus type 16
LQFIFQLCK

SEQ ID NO: 1997 - protein, 9 aa, Human papillomavirus type 16
IFQLCKITL

SEQ ID NO: 1998 - protein, 9 aa, Human papillomavirus type 16
LQPPPGGTL

SEQ ID NO: 1999 - protein, 9 aa, Human papillomavirus type 16
YRFVTQAIA

SEQ ID NO: 2000 - protein, 9 aa, Human papillomavirus type 16
KYTFWEVNL

SEQ ID NO: 2001 - protein, 9 aa, Human papillomavirus type 16
KFSADLDQF

SEQ ID NO: 2002 - protein, 9 aa, Human papillomavirus type 16
DQFPLGRKF

SEQ ID NO: 2003 - protein, 9 aa, Human papillomavirus type 16
QFPLGRKFL

SEQ ID NO: 2004 - protein, 9 aa, Human papillomavirus type 16
FPLGRKFLL

SEQ ID NO: 2005 - protein, 9 aa, Human papillomavirus type 16
KRKATPTTS

SEQ ID NO: 2006 - protein, 9 aa, Human papillomavirus type 16
TAKRKKRKL

SEQ ID NO: 2007 - protein, 10 aa, Human papillomavirus type 16
VYHIFFQMSL

SEQ ID NO: 2008 - protein, 10 aa, Human papillomavirus type 16
SLWLPSEATV

SEQ ID NO: 2009 - protein, 10 aa, Human papillomavirus type 16
WLPSEATVYL

SEQ ID NO: 2010 - protein, 10 aa, Human papillomavirus type 16
YLPPVPVSKV

SEQ ID NO: 2011 - protein, 10 aa, Human papillomavirus type 16
LPPVPVSKVV

SEQ ID NO: 2012 - protein, 10 aa, Human papillomavirus type 16
VVSTDEYVAR

SEQ ID NO: 2013 - protein, 10 aa, Human papillomavirus type 16
IYYHAGTSRL

SEQ ID NO: 2014 - protein, 10 aa, Human papillomavirus type 16
YYHAGTSRLL

SEQ ID NO: 2015 - protein, 10 aa, Human papillomavirus type 16
HAGTSRLLAV

SEQ ID NO: 2016 - protein, 10 aa, Human papillomavirus type 16
SRLLAVGHPY

SEQ ID NO: 2017 - protein, 10 aa, Human papillomavirus type 16
LAVGHPYFPI

SEQ ID NO: 2018 - protein, 10 aa, Human papillomavirus type 16
AVGHPYFPIK

SEQ ID NO: 2019 - protein, 10 aa, Human papillomavirus type 16
KILVPKVSGL

SEQ ID NO: 2020 - protein, 10 aa, Human papillomavirus type 16
SGLQYRVFRI

SEQ ID NO: 2021 - protein, 10 aa, Human papillomavirus type 16
LQYRVFRIHL

SEQ ID NO: 2022 - protein, 10 aa, Human papillomavirus type 16
FRIHLPDPNK

SEQ ID NO: 2023 - protein, 10 aa, Human papillomavirus type 16
SFYNPDTQRL

SEQ ID NO: 2024 - protein, 10 aa, Human papillomavirus type 16
QRLVWACVGV

SEQ ID NO: 2025 - protein, 10 aa, Human papillomavirus type 16
GRGQPLGVGI

SEQ ID NO: 2026 - protein, 10 aa, Human papillomavirus type 16
NAGVDNRECI

SEQ ID NO: 2027 - protein, 10 aa, Human papillomavirus type 16
NRECISMDYK

SEQ ID NO: 2028 - protein, 10 aa, Human papillomavirus type 16
NPGDCPPLEL

SEQ ID NO: 2029 - protein, 10 aa, Human papillomavirus type 16
CPPLELINTV

SEQ ID NO: 2030 - protein, 10 aa, Human papillomavirus type 16
PPLELINTVI

SEQ ID NO: 2031 - protein, 10 aa, Human papillomavirus type 16
GFGAMDFTTL

SEQ ID NO: 2032 - protein, 10 aa, Human papillomavirus type 16
LQANKSEVPL

SEQ ID NO: 2033 - protein, 10 aa, Human papillomavirus type 16
VSEPYGDSLF

SEQ ID NO: 2034 - protein, 10 aa, Human papillomavirus type 16
LFFYLRREQM

SEQ ID NO: 2035 - protein, 10 aa, Human papillomavirus type 16
FFYLRREQMF

SEQ ID NO: 2036 - protein, 10 aa, Human papillomavirus type 16
LRREQMFVRH

SEQ ID NO: 2037 - protein, 10 aa, Human papillomavirus type 16
RREQMFVRHL

SEQ ID NO: 2038 - protein, 10 aa, Human papillomavirus type 16
QMFVRHLFNR

SEQ ID NO: 2039 - protein, 10 aa, Human papillomavirus type 16
VRHLFNRAGT

SEQ ID NO: 2040 - protein, 10 aa, Human papillomavirus type 16
NRAGTVGENV

SEQ ID NO: 2041 - protein, 10 aa, Human papillomavirus type 16
NYFPTPSGSM

SEQ ID NO: 2042 - protein, 10 aa, Human papillomavirus type 16
AQIFNKPYWL

SEQ ID NO: 2043 - protein, 10 aa, Human papillomavirus type 16
QRAQGHNNGI

SEQ ID NO: 2044 - protein, 10 aa, Human papillomavirus type 16
TRSTNMSLCA

SEQ ID NO: 2045 - protein, 10 aa, Human papillomavirus type 16
KEYLRHGEEY

SEQ ID NO: 2046 - protein, 10 aa, Human papillomavirus type 16
EYDLQFIFQL

SEQ ID NO: 2047 - protein, 10 aa, Human papillomavirus type 16
LQFIFQLCKI

SEQ ID NO: 2048 - protein, 10 aa, Human papillomavirus type 16
TLTADVMTYI

SEQ ID NO: 2049 - protein, 10 aa, Human papillomavirus type 16
TILEDWNFGL

SEQ ID NO: 2050 - protein, 10 aa, Human papillomavirus type 16
YRFVTQAIAC

SEQ ID NO: 2051 - protein, 10 aa, Human papillomavirus type 16
FVTQAIACQK

SEQ ID NO: 2052 - protein, 10 aa, Human papillomavirus type 16
CQKHTPPAPK

SEQ ID NO: 2053 - protein, 10 aa, Human papillomavirus type 16
QFPLGRKFLL

SEQ ID NO: 2054 - protein, 10 aa, Human papillomavirus type 16
GRKFLLQAGL

SEQ ID NO: 2055 - protein, 10 aa, Human papillomavirus type 16
KRKATPTTSS

SEQ ID NO: 2056 - protein, 9 aa, Human papillomavirus type 16
FFTLHYVQL

SEQ ID NO: 2057 - protein, 9 aa, Human papillomavirus type 16
YVQLLNHYV

SEQ ID NO: 2058 - protein, 9 aa, Human papillomavirus type 16
LLNHYVHCV

SEQ ID NO: 2059 - protein, 10 aa, Human papillomavirus type 16
CLPTIPLFFT

SEQ ID NO: 2060 - protein, 10 aa, Human papillomavirus type 16
LPTIPLFFTL

SEQ ID NO: 2061 - protein, 10 aa, Human papillomavirus type 16
IPLFFTLHYV

SEQ ID NO: 2062 - protein, 10 aa, Human papillomavirus type 16
LFFTLHYVQL

SEQ ID NO: 2063 - protein, 10 aa, Human papillomavirus type 16
FFTLHYVQLL

SEQ ID NO: 2064 - protein, 10 aa, Human papillomavirus type 16
QLLNHYVHCV

SEQ ID NO: 2065 - protein, 8 aa, Human papillomavirus type 16
MGIHMLYV

SEQ ID NO: 2066 - protein, 9 aa, Human papillomavirus type 16
MGIHMLYVI

SEQ ID NO: 2067 - protein, 8 aa, Human papillomavirus type 16
CRGCSGKK

SEQ ID NO: 2068 - protein, 10 aa, Human papillomavirus type 16
MVLCRGCSGK

SEQ ID NO: 2069 - protein, 10 aa, Human papillomavirus type 16
CRGCSGKKNR

SEQ ID NO: 2070 - protein, 8 aa, Human papillomavirus type 16
YGVSFSEL

SEQ ID NO: 2071 - protein, 8 aa, Human papillomavirus type 16
VRPFKSNK

SEQ ID NO: 2072 - protein, 8 aa, Human papillomavirus type 16
TPSIADSI

SEQ ID NO: 2073 - protein, 8 aa, Human papillomavirus type 16
LQQYCLYL

SEQ ID NO: 2074 - protein, 8 aa, Human papillomavirus type 16
QQYCLYLH

SEQ ID NO: 2075 - protein, 8 aa, Human papillomavirus type 16
LACSWGMV

SEQ ID NO: 2076 - protein, 8 aa, Human papillomavirus type 16
VRYKCGKN

SEQ ID NO: 2077 - protein, 8 aa, Human papillomavirus type 16
NRETIEKL

SEQ ID NO: 2078 - protein, 9 aa, Human papillomavirus type 16
GRHETETPC

SEQ ID NO: 2079 - protein, 9 aa, Human papillomavirus type 16
ETETPCSQY

SEQ ID NO: 2080 - protein, 9 aa, Human papillomavirus type 16
EGVSERHTI

SEQ ID NO: 2081 - protein, 9 aa, Human papillomavirus type 16
CQTPLTNIL

SEQ ID NO: 2082 - protein, 9 aa, Human papillomavirus type 16
TPLTNILNV

SEQ ID NO: 2083 - protein, 9 aa, Human papillomavirus type 16
NVLKTSNAK

SEQ ID NO: 2084 - protein, 9 aa, Human papillomavirus type 16
AMLAKFKEL

SEQ ID NO: 2085 - protein, 9 aa, Human papillomavirus type 16
LYGVSFSEL

SEQ ID NO: 2086 - protein, 9 aa, Human papillomavirus type 16
YGVSFSELV

SEQ ID NO: 2087 - protein, 9 aa, Human papillomavirus type 16
GVSFSELVR

SEQ ID NO: 2088 - protein, 9 aa, Human papillomavirus type 16
SFSELVRPF

SEQ ID NO: 2089 - protein, 9 aa, Human papillomavirus type 16
LVRPFKSNK

SEQ ID NO: 2090 - protein, 9 aa, Human papillomavirus type 16
VRPFKSNKS

SEQ ID NO: 2091 - protein, 9 aa, Human papillomavirus type 16
AAFGLTPSI

SEQ ID NO: 2092 - protein, 9 aa, Human papillomavirus type 16
LLQQYCLYL

SEQ ID NO: 2093 - protein, 9 aa, Human papillomavirus type 16
QQYCLYLHI

SEQ ID NO: 2094 - protein, 9 aa, Human papillomavirus type 16
CLYLHIQSL

SEQ ID NO: 2095 - protein, 9 aa, Human papillomavirus type 16
LACSWGMVV

SEQ ID NO: 2096 - protein, 9 aa, Human papillomavirus type 16
VVLLLVRYK

SEQ ID NO: 2097 - protein, 9 aa, Human papillomavirus type 16
VRYKCGKNR

SEQ ID NO: 2098 - protein, 9 aa, Human papillomavirus type 16
NRETIEKLL

SEQ ID NO: 2099 - protein, 9 aa, Human papillomavirus type 16
ETIEKLLSK

SEQ ID NO: 2100 - protein, 9 aa, Human papillomavirus type 16
IEKLLSKLL

SEQ ID NO: 2101 - protein, 9 aa, Human papillomavirus type 16
KLLSKLLCV

SEQ ID NO: 2102 - protein, 10 aa, Human papillomavirus type 16
GRHETETPCS

SEQ ID NO: 2103 - protein, 10 aa, Human papillomavirus type 16
ERHTICQTPL

SEQ ID NO: 2104 - protein, 10 aa, Human papillomavirus type 16
TPLTNILNVL

SEQ ID NO: 2105 - protein, 10 aa, Human papillomavirus type 16
AAMLAKFKEL

SEQ ID NO: 2106 - protein, 10 aa, Human papillomavirus type 16
LAKFKELYGV

SEQ ID NO: 2107 - protein, 10 aa, Human papillomavirus type 16
KFKELYGVSF

SEQ ID NO: 2108 - protein, 10 aa, Human papillomavirus type 16
ELYGVSFSEL

SEQ ID NO: 2109 - protein, 10 aa, Human papillomavirus type 16
KSNKSTCCDW

SEQ ID NO: 2110 - protein, 10 aa, Human papillomavirus type 16
IAAFGLTPSI

SEQ ID NO: 2111 - protein, 10 aa, Human papillomavirus type 16
TLLQQYCLYL

SEQ ID NO: 2112 - protein, 10 aa, Human papillomavirus type 16
MVVLLLVRYK

SEQ ID NO: 2113 - protein, 10 aa, Human papillomavirus type 16
LVRYKCGKNR

SEQ ID NO: 2114 - protein, 10 aa, Human papillomavirus type 16
VRYKCGKNRE

SEQ ID NO: 2115 - protein, 10 aa, Human papillomavirus type 16
NRETIEKLLS

SEQ ID NO: 2116 - protein, 10 aa, Human papillomavirus type 16
YLLQGQRNGI

SEQ ID NO: 2117 - protein, 8 aa, Human papillomavirus type 16
MQYNALYK

SEQ ID NO: 2118 - protein, 9 aa, Human papillomavirus type 16
MQYNALYKL

SEQ ID NO: 2119 - protein, 9 aa, Human papillomavirus type 16
ALYKLDTYI

SEQ ID NO: 2120 - protein, 9 aa, Human papillomavirus type 16
YKLDTYIYL

SEQ ID NO: 2121 - protein, 10 aa, Human papillomavirus type 16
NALYKLDTYI

SEQ ID NO: 2122 - protein, 10 aa, Human papillomavirus type 16
LYKLDTYIYL

SEQ ID NO: 2123 - protein, 9 aa, Human papillomavirus type 16
LDTASTTLL

SEQ ID NO: 2124 - protein, 10 aa, Human papillomavirus type 16
LLACFLLCFV

SEQ ID NO: 2125 - protein, 9 aa, Human papillomavirus type 16
MLVHQHLYL

SEQ ID NO: 2126 - protein, 9 aa, Human papillomavirus type 16
MWIIHYIFL

SEQ ID NO: 2127 - protein, 9 aa, Human papillomavirus type 16
WIIHYIFLV

SEQ ID NO: 2128 - protein, 9 aa, Human papillomavirus type 16
YIFLVMIIV

SEQ ID NO: 2129 - protein, 9 aa, Human papillomavirus type 16
IFLVMIIVL

SEQ ID NO: 2130 - protein, 9 aa, Human papillomavirus type 16
FLVMIIVLI

SEQ ID NO: 2131 - protein, 10 aa, Human papillomavirus type 16
YIFLVMIIVL

SEQ ID NO: 2132 - protein, 8 aa, Human papillomavirus type 16
MQPHLLLL

SEQ ID NO: 2133 - protein, 8 aa, Human papillomavirus type 16
QPHLLLLI

SEQ ID NO: 2134 - protein, 8 aa, Human papillomavirus type 16
LQILLQPR

SEQ ID NO: 2135 - protein, 8 aa, Human papillomavirus type 16
LQPRYHLY

SEQ ID NO: 2136 - protein, 8 aa, Human papillomavirus type 16
PRYHLYPL

SEQ ID NO: 2137 - protein, 8 aa, Human papillomavirus type 16
YHLYPLHL

SEQ ID NO: 2138 - protein, 9 aa, Human papillomavirus type 16
QPHLLLLIM

SEQ ID NO: 2139 - protein, 9 aa, Human papillomavirus type 16
LLLLIMDYM

SEQ ID NO: 2140 - protein, 9 aa, Human papillomavirus type 16
LIMDYMIFM

SEQ ID NO: 2141 - protein, 9 aa, Human papillomavirus type 16
MQMTLLQIL

SEQ ID NO: 2142 - protein, 9 aa, Human papillomavirus type 16
LQILLQPRY

SEQ ID NO: 2143 - protein, 9 aa, Human papillomavirus type 16
ILLQPRYHL

SEQ ID NO: 2144 - protein, 9 aa, Human papillomavirus type 16
QPRYHLYPL

SEQ ID NO: 2145 - protein, 9 aa, Human papillomavirus type 16
PRYHLYPLH

SEQ ID NO: 2146 - protein, 9 aa, Human papillomavirus type 16
RYHLYPLHL

SEQ ID NO: 2147 - protein, 10 aa, Human papillomavirus type 16
MQPHLLLLIM

SEQ ID NO: 2148 - protein, 10 aa, Human papillomavirus type 16
LLIMDYMIFM

SEQ ID NO: 2149 - protein, 10 aa, Human papillomavirus type 16
DYMIFMQMTL

SEQ ID NO: 2150 - protein, 10 aa, Human papillomavirus type 16
YMIFMQMTLL

SEQ ID NO: 2151 - protein, 10 aa, Human papillomavirus type 16
MQMTLLQILL

SEQ ID NO: 2152 - protein, 10 aa, Human papillomavirus type 16
LQPRYHLYPL

SEQ ID NO: 2153 - protein, 10 aa, Human papillomavirus type 16
PRYHLYPLHL

SEQ ID NO: 2154 - protein, 8 aa, Human papillomavirus type 16
KLYVCLYV

SEQ ID NO: 2155 - protein, 8 aa, Human papillomavirus type 16
CLYVWYNK

SEQ ID NO: 2156 - protein, 9 aa, Human papillomavirus type 16
CLYVLVNIK

SEQ ID NO: 2157 - protein, 9 aa, Human papillomavirus type 16
LYVLVNIKL

SEQ ID NO: 2158 - protein, 9 aa, Human papillomavirus type 16
VLVNIKLYV

SEQ ID NO: 2159 - protein, 9 aa, Human papillomavirus type 16
VNIKLYVCL

SEQ ID NO: 2160 - protein, 10 aa, Human papillomavirus type 16
CLYVLVNIKL

SEQ ID NO: 2161 - protein, 10 aa, Human papillomavirus type 16
YVLVNIKLYV

SEQ ID NO: 2162 - protein, 10 aa, Human papillomavirus type 16
KLYVCLYVWY

SEQ ID NO: 2163 - protein, 10 aa, Human papillomavirus type 16
YVCLYVWYNK

SEQ ID NO: 2164 - protein, 10 aa, Human papillomavirus type 16
CLYVWYNKHV

SEQ ID NO: 2165 - protein, 10 aa, Human papillomavirus type 16
WYNKHVCMCF

SEQ ID NO: 2166 - protein, 9 aa, Human papillomavirus type 16
FGLHIYKQL

SEQ ID NO: 2167 - protein, 10 aa, Human papillomavirus type 16
KVSHTLFICK

SEQ ID NO: 2168 - protein, 10 aa, Human papillomavirus type 16
VQTDFGLHIY

SEQ ID NO: 2169 - protein, 10 aa, Human papillomavirus type 16
QTDFGLHIYK

SEQ ID NO: 2170 - protein, 10 aa, Human papillomavirus type 16
DFGLHIYKQL

SEQ ID NO: 2171 - protein, 10 aa, Human papillomavirus type 16
FGLHIYKQLI

SEQ ID NO: 2172 - protein, 8 aa, Human papillomavirus type 16
LGYKPISI

SEQ ID NO: 2173 - protein, 9 aa, Human papillomavirus type 16
LGYKPISIF

SEQ ID NO: 2174 - protein, 8 aa, Human papillomavirus type 16
GPNQPLCI

SEQ ID NO: 2175 - protein, 8 aa, Human papillomavirus type 16
QPLCIWII

SEQ ID NO: 2176 - protein, 9 aa, Human papillomavirus type 16
TYTGPNQPL

SEQ ID NO: 2177 - protein, 9 aa, Human papillomavirus type 16
NQPLCIWII

SEQ ID NO: 2178 - protein, 10 aa, Human papillomavirus type 16
GPNQPLCIWI

SEQ ID NO: 2179 - protein, 10 aa, Human papillomavirus type 16
NQPLCIWIIK

SEQ ID NO: 2180 - protein, 9 aa, Human papillomavirus type 16
MVNVYVVFV

SEQ ID NO: 2181 - protein, 10 aa, Human papillomavirus type 16
NMVNVYVVFV

SEQ ID NO: 2182 - protein, 8 aa, Human papillomavirus type 16
HQKELLYL

SEQ ID NO: 2183 - protein, 8 aa, Human papillomavirus type 16
LQEYNLIK

SEQ ID NO: 2184 - protein, 9 aa, Human papillomavirus type 16
KEYCMHHQK

SEQ ID NO: 2185 - protein, 9 aa, Human papillomavirus type 16
HHQKELLYL

SEQ ID NO: 2186 - protein, 9 aa, Human papillomavirus type 16
LLYLQEYNL

SEQ ID NO: 2187 - protein, 9 aa, Human papillomavirus type 16
YLQEYNLIK

SEQ ID NO: 2188 - protein, 10 aa, Human papillomavirus type 16
EYCMHHQKEL

SEQ ID NO: 2189 - protein, 10 aa, Human papillomavirus type 16
MHHQKELLYL

SEQ ID NO: 2190 - protein, 10 aa, Human papillomavirus type 16
YLQEYNLIKM

SEQ ID NO: 2191 - protein, 9 aa, Human papillomavirus type 16
QLYPKSQDL

SEQ ID NO: 2192 - protein, 9 aa, Human papillomavirus type 16
YPKSQDLEL

SEQ ID NO: 2193 - protein, 10 aa, Human papillomavirus type 16
KQLYPKSQDL

SEQ ID NO: 2194 - protein, 10 aa, Human papillomavirus type 16
LYPKSQDLEL

SEQ ID NO: 2195 - protein, 10 aa, Human papillomavirus type 16
YPKSQDLELY

SEQ ID NO: 2196 - protein, 8 aa, Human papillomavirus type 16
GEWKVQML

SEQ ID NO: 2197 - protein, 9 aa, Human papillomavirus type 16
LIHLGEWKV

SEQ ID NO: 2198 - protein, 8 aa, Human papillomavirus type 16
KGVLQEQV

SEQ ID NO: 2199 - protein, 8 aa, Human papillomavirus type 16
VRLYPTLF

SEQ ID NO: 2200 - protein, 8 aa, Human papillomavirus type 16
YPTLFQFL

SEQ ID NO: 2201 - protein, 8 aa, Human papillomavirus type 16
FQFLTHQK

SEQ ID NO: 2202 - protein, 8 aa, Human papillomavirus type 16
HQKIHPYF

SEQ ID NO: 2203 - protein, 8 aa, Human papillomavirus type 16
HPYFHIVI

SEQ ID NO: 2204 - protein, 9 aa, Human papillomavirus type 16
FPMEYTQCV

SEQ ID NO: 2205 - protein, 9 aa, Human papillomavirus type 16
MEYTQCVRL

SEQ ID NO: 2206 - protein, 9 aa, Human papillomavirus type 16
QCVRLYPTL

SEQ ID NO: 2207 - protein, 9 aa, Human papillomavirus type 16
RLYPTLFQF

SEQ ID NO: 2208 - protein, 9 aa, Human papillomavirus type 16
LYPTLFQFL

SEQ ID NO: 2209 - protein, 9 aa, Human papillomavirus type 16
FQFLTHQKI

SEQ ID NO: 2210 - protein, 9 aa, Human papillomavirus type 16
HPYFHIVIF

SEQ ID NO: 2211 - protein, 10 aa, Human papillomavirus type 16
TQCVRLYPTL

SEQ ID NO: 2212 - protein, 10 aa, Human papillomavirus type 16
VRLYPTLFQF

SEQ ID NO: 2213 - protein, 10 aa, Human papillomavirus type 16
RLYPTLFQFL

SEQ ID NO: 2214 - protein, 10 aa, Human papillomavirus type 16
TLFQFLTHQK

SEQ ID NO: 2215 - protein, 10 aa, Human papillomavirus type 16
HPYFHIVIFV

SEQ ID NO: 2216 - protein, 9 aa, Human papillomavirus type 16
LPVCMFYKV

SEQ ID NO: 2217 - protein, 10 aa, Human papillomavirus type 16
LLLSTIVIPI

SEQ ID NO: 2218 - protein, 8 aa, Human papillomavirus type 16
NAVRIGAL

SEQ ID NO: 2219 - protein, 8 aa, Human papillomavirus type 16
VRIGALST

SEQ ID NO: 2220 - protein, 8 aa, Human papillomavirus type 16
GALSTESL

SEQ ID NO: 2221 - protein, 8 aa, Human papillomavirus type 16
FPVSGSDL

SEQ ID NO: 2222 - protein, 8 aa, Human papillomavirus type 16
GRWIVVCV

SEQ ID NO: 2223 - protein, 8 aa, Human papillomavirus type 16
VPKATALV

SEQ ID NO: 2224 - protein, 8 aa, Human papillomavirus type 16
KATALVWV

SEQ ID NO: 2225 - protein, 8 aa, Human papillomavirus type 16
LAKCCLII

SEQ ID NO: 2226 - protein, 9 aa, Human papillomavirus type 16
GFPVSGSDL

SEQ ID NO: 2227 - protein, 9 aa, Human papillomavirus type 16
VSGSDLGRW

SEQ ID NO: 2228 - protein, 9 aa, Human papillomavirus type 16
GRWIVVCVS

SEQ ID NO: 2229 - protein, 9 aa, Human papillomavirus type 16
WIVVCVSSV

SEQ ID NO: 2230 - protein, 9 aa, Human papillomavirus type 16
VVCVSSVPK

SEQ ID NO: 2231 - protein, 9 aa, Human papillomavirus type 16
SSVPKATAL

SEQ ID NO: 2232 - protein, 9 aa, Human papillomavirus type 16
WVAAGWLAK

SEQ ID NO: 2233 - protein, 9 aa, Human papillomavirus type 16
AGWLAKCCL

SEQ ID NO: 2234 - protein, 10 aa, Human papillomavirus type 16
VRIGALSTES

SEQ ID NO: 2235 - protein, 10 aa, Human papillomavirus type 16
NLVVWQGFPV

SEQ ID NO: 2236 - protein, 10 aa, Human papillomavirus type 16
QGFPVSGSDL

SEQ ID NO: 2237 - protein, 10 aa, Human papillomavirus type 16
GRWIVVCVSS

SEQ ID NO: 2238 - protein, 10 aa, Human papillomavirus type 16
IVVCVSSVPK

SEQ ID NO: 2239 - protein, 10 aa, Human papillomavirus type 16
VPKATALVWV

SEQ ID NO: 2240 - protein, 10 aa, Human papillomavirus type 16
AGWLAKCCLI

SEQ ID NO: 2241 - protein, 8 aa, Human papillomavirus type 16
TPTSTTIL

SEQ ID NO: 2242 - protein, 9 aa, Human papillomavirus type 16
TSTTILTTW

SEQ ID NO: 2243 - protein, 9 aa, Human papillomavirus type 16
ILTTWCFSL

SEQ ID NO: 2244 - protein, 10 aa, Human papillomavirus type 16
TATTPTSTTI

SEQ ID NO: 2245 - protein, 10 aa, Human papillomavirus type 16
CFSLMAPFYL

SEQ ID NO: 2246 - protein, 10 aa, Human papillomavirus type 16
HFSIAIPAVF

SEQ ID NO: 2247 - protein, 9 aa, Human papillomavirus type 16
SACPAGPSI

SEQ ID NO: 2248 - protein, 8 aa, Human papillomavirus type 16
APVGPETL

SEQ ID NO: 2249 - protein, 9 aa, Human papillomavirus type 16
CITVVTFWV

SEQ ID NO: 2250 - protein, 10 aa, Human papillomavirus type 16
MQPNSVEATK

SEQ ID NO: 2251 - protein, 10 aa, Human papillomavirus type 16
NSVEATKWAW

SEQ ID NO: 2252 - protein, 10 aa, Human papillomavirus type 16
SVEATKWAWR

SEQ ID NO: 2253 - protein, 8 aa, Human papillomavirus type 16
IRAYNLRY

SEQ ID NO: 2254 - protein, 8 aa, Human papillomavirus type 16
RRQVDSGL

SEQ ID NO: 2255 - protein, 8 aa, Human papillomavirus type 16
TRQPKRHL

SEQ ID NO: 2256 - protein, 8 aa, Human papillomavirus type 16
RQPKRHLK

SEQ ID NO: 2257 - protein, 8 aa, Human papillomavirus type 16
KRHLKKNM

SEQ ID NO: 2258 - protein, 9 aa, Human papillomavirus type 16
IYVCACNIF

SEQ ID NO: 2259 - protein, 9 aa, Human papillomavirus type 16
LRYWDRRQV

SEQ ID NO: 2260 - protein, 9 aa, Human papillomavirus type 16
DRRQVDSGL

SEQ ID NO: 2261 - protein, 9 aa, Human papillomavirus type 16
RRQVDSGLT

SEQ ID NO: 2262 - protein, 9 aa, Human papillomavirus type 16
RQVDSGLTR

SEQ ID NO: 2263 - protein, 9 aa, Human papillomavirus type 16
TRQPKRHLK

SEQ ID NO: 2264 - protein, 9 aa, Human papillomavirus type 16
RQPKRHLKK

SEQ ID NO: 2265 - protein, 9 aa, Human papillomavirus type 16
KRHLKKNMV

SEQ ID NO: 2266 - protein, 10 aa, Human papillomavirus type 16
YVCACNIFIR

SEQ ID NO: 2267 - protein, 10 aa, Human papillomavirus type 16
LRYWDRRQVD

SEQ ID NO: 2268 - protein, 10 aa, Human papillomavirus type 16
RRQVDSGLTR

SEQ ID NO: 2269 - protein, 10 aa, Human papillomavirus type 16
TRQPKRHLKK

SEQ ID NO: 2270 - protein, 10 aa, Human papillomavirus type 16
QPKRHLKKNM

SEQ ID NO: 2271 - protein, 10 aa, Human papillomavirus type 16
KRHLKKNMVN

SEQ ID NO: 2272 - protein, 10 aa, Human papillomavirus type 16
HLKKNMVNVY

SEQ ID NO: 2273 - protein, 9 aa, Human papillomavirus type 16
YYPHLYLHM

SEQ ID NO: 2274 - protein, 10 aa, Human papillomavirus type 16
MYYPHLYLHM

SEQ ID NO: 2275 - protein, 10 aa, Human papillomavirus type 16
LYLHMQDYHM

SEQ ID NO: 2276 - protein, 10 aa, Human papillomavirus type 16
YLPVCMFYKV

SEQ ID NO: 2277 - protein, 8 aa, Human papillomavirus type 16
LQNVCVAL

SEQ ID NO: 2278 - protein, 9 aa, Human papillomavirus type 16
LQNVCVALL

SEQ ID NO: 2279 - protein, 9 aa, Human papillomavirus type 16
VALLSNNSL

SEQ ID NO: 2280 - protein, 10 aa, Human papillomavirus type 16
VLCVLQNVCV

SEQ ID NO: 2281 - protein, 10 aa, Human papillomavirus type 16
VALLSNNSLL

SEQ ID NO: 2282 - protein, 10 aa, Human papillomavirus type 16
KQTNKKKNYI

SEQ ID NO: 2283 - protein, 8 aa, Human papillomavirus type 16
IRPLCELL

SEQ ID NO: 2284 - protein, 9 aa, Human papillomavirus type 16
VVLLLQLIR

SEQ ID NO: 2285 - protein, 9 aa, Human papillomavirus type 16
IRPLCELLN

SEQ ID NO: 2286 - protein, 10 aa, Human papillomavirus type 16
MGVVLLLQLI

SEQ ID NO: 2287 - protein, 10 aa, Human papillomavirus type 16
GVVLLLQLIR

SEQ ID NO: 2288 - protein, 10 aa, Human papillomavirus type 16
LQLIRPLCEL

SEQ ID NO: 2289 - protein, 10 aa, Human papillomavirus type 16
IRPLCELLNA

SEQ ID NO: 2290 - protein, 10 aa, Human papillomavirus type 16
RPLCELLNAV

SEQ ID NO: 2291 - protein, 8 aa, Human papillomavirus type 16
SRLTSCNV

SEQ ID NO: 2292 - protein, 9 aa, Human papillomavirus type 16
SPSNCTSTV

SEQ ID NO: 2293 - protein, 9 aa, Human papillomavirus type 16
YPCFFIHPV

SEQ ID NO: 2294 - protein, 9 aa, Human papillomavirus type 16
GAVKYTSRL

SEQ ID NO: 2295 - protein, 9 aa, Human papillomavirus type 16
SRLTSCNVH

SEQ ID NO: 2296 - protein, 9 aa, Human papillomavirus type 16
HFSLLYCEL

SEQ ID NO: 2297 - protein, 9 aa, Human papillomavirus type 16
SLLYCELYI

SEQ ID NO: 2298 - protein, 9 aa, Human papillomavirus type 16
LLYCELYIV

SEQ ID NO: 2299 - protein, 9 aa, Human papillomavirus type 16
ALFFDTASV

SEQ ID NO: 2300 - protein, 10 aa, Human papillomavirus type 16
SRLTSCNVHF

SEQ ID NO: 2301 - protein, 10 aa, Human papillomavirus type 16
VHFSLLYCEL

SEQ ID NO: 2302 - protein, 10 aa, Human papillomavirus type 16
SLLYCELYIV

SEQ ID NO: 2303 - protein, 10 aa, Human papillomavirus type 16
NALFFDTASV

SEQ ID NO: 2304 - protein, 8 aa, Human papillomavirus type 16
FRIYKTYY

SEQ ID NO: 2305 - protein, 8 aa, Human papillomavirus type 16
YRPLQKFH

SEQ ID NO: 2306 - protein, 9 aa, Human papillomavirus type 16
FRIYKTYYR

SEQ ID NO: 2307 - protein, 9 aa, Human papillomavirus type 16
IYKTYYRPL

SEQ ID NO: 2308 - protein, 9 aa, Human papillomavirus type 16
KTYYRPLQK

SEQ ID NO: 2309 - protein, 9 aa, Human papillomavirus type 16
TYYRPLQKF

SEQ ID NO: 2310 - protein, 10 aa, Human papillomavirus type 16
RIYKTYYRPL

SEQ ID NO: 2311 - protein, 10 aa, Human papillomavirus type 16
KTYYRPLQKF

SEQ ID NO: 2312 - protein, 8 aa, Human papillomavirus type 16
NRSSKVRM

SEQ ID NO: 2313 - protein, 8 aa, Human papillomavirus type 16
VRMSTCVL

SEQ ID NO: 2314 - protein, 8 aa, Human papillomavirus type 16
NRSVESHL

SEQ ID NO: 2315 - protein, 8 aa, Human papillomavirus type 16
LQQKVTIL

SEQ ID NO: 2316 - protein, 9 aa, Human papillomavirus type 16
SVPINRSSK

SEQ ID NO: 2317 - protein, 9 aa, Human papillomavirus type 16
VPINRSSKV

SEQ ID NO: 2318 - protein, 9 aa, Human papillomavirus type 16
KVRMSTCVL

SEQ ID NO: 2319 - protein, 9 aa, Human papillomavirus type 16
VRMSTCVLC

SEQ ID NO: 2320 - protein, 9 aa, Human papillomavirus type 16
SVESHLQQK

SEQ ID NO: 2321 - protein, 10 aa, Human papillomavirus type 16
HTIPSVPINR

SEQ ID NO: 2322 - protein, 10 aa, Human papillomavirus type 16
NRSSKVRMST

SEQ ID NO: 2323 - protein, 10 aa, Human papillomavirus type 16
VRMSTCVLCT

SEQ ID NO: 2324 - protein, 10 aa, Human papillomavirus type 16
SHLQQKVTIL

SEQ ID NO: 2325 - protein, 8 aa, Human papillomavirus type 16
AGFLYVFL

SEQ ID NO: 2326 - protein, 8 aa, Human papillomavirus type 16
DRSTDPLY

SEQ ID NO: 2327 - protein, 8 aa, Human papillomavirus type 16
FAFLQDTV

SEQ ID NO: 2328 - protein, 9 aa, Human papillomavirus type 16
MITAGFLYV

SEQ ID NO: 2329 - protein, 9 aa, Human papillomavirus type 16
ITAGFLYVF

SEQ ID NO: 2330 - protein, 9 aa, Human papillomavirus type 16
FLYVFLMIC

SEQ ID NO: 2331 - protein, 9 aa, Human papillomavirus type 16
YVFLMICNK

SEQ ID NO: 2332 - protein, 9 aa, Human papillomavirus type 16
DRSTDPLYY

SEQ ID NO: 2333 - protein, 9 aa, Human papillomavirus type 16
GIFAFCPDV

SEQ ID NO: 2334 - protein, 9 aa, Human papillomavirus type 16
IFAFCPDVF

SEQ ID NO: 2335 - protein, 9 aa, Human papillomavirus type 16
AFCPDVFAF

SEQ ID NO: 2336 - protein, 9 aa, Human papillomavirus type 16
AFLQDTVAF

SEQ ID NO: 2337 - protein, 10 aa, Human papillomavirus type 16
AGFLYVFLMI

SEQ ID NO: 2338 - protein, 10 aa, Human papillomavirus type 16
FLMICNKTYI

SEQ ID NO: 2339 - protein, 10 aa, Human papillomavirus type 16
TYIDRSTDPL

SEQ ID NO: 2340 - protein, 10 aa, Human papillomavirus type 16
STDPLYYGIF

SEQ ID NO: 2341 - protein, 10 aa, Human papillomavirus type 16
YGIFAFCPDV

SEQ ID NO: 2342 - protein, 10 aa, Human papillomavirus type 16
AFCPDVFAFL

SEQ ID NO: 2343 - protein, 8 aa, Human papillomavirus type 16
NPEKQSHI

SEQ ID NO: 2344 - protein, 8 aa, Human papillomavirus type 16
KQSHIPHV

SEQ ID NO: 2345 - protein, 8 aa, Human papillomavirus type 16
IPHVAVTV

SEQ ID NO: 2346 - protein, 9 aa, Human papillomavirus type 16
VACSTHILI

SEQ ID NO: 2347 - protein, 10 aa, Human papillomavirus type 16
KQSHIPHVAV

SEQ ID NO: 2348 - protein, 8 aa, Human papillomavirus type 16
LRVVSTTV

SEQ ID NO: 2349 - protein, 8 aa, Human papillomavirus type 16
LPQQMPLL

SEQ ID NO: 2350 - protein, 9 aa, Human papillomavirus type 16
LRVVSTTVT

SEQ ID NO: 2351 - protein, 9 aa, Human papillomavirus type 16
VSTTVTNSW

SEQ ID NO: 2352 - protein, 9 aa, Human papillomavirus type 16
SWLPQQMPL

SEQ ID NO: 2353 - protein, 9 aa, Human papillomavirus type 16
WLPQQMPLL

SEQ ID NO: 2354 - protein, 10 aa, Human papillomavirus type 16
LRVVSTTVTN

SEQ ID NO: 2355 - protein, 10 aa, Human papillomavirus type 16
SWLPQQMPLL

SEQ ID NO: 2356 - protein, 8 aa, Human papillomavirus type 16
FAVDPEPL

SEQ ID NO: 2357 - protein, 8 aa, Human papillomavirus type 16
SPTVPALL

SEQ ID NO: 2358 - protein, 9 aa, Human papillomavirus type 16
KFAVDPEPL

SEQ ID NO: 2359 - protein, 9 aa, Human papillomavirus type 16
AVDPEPLMY

SEQ ID NO: 2360 - protein, 9 aa, Human papillomavirus type 16
LMYKSSGTF

SEQ ID NO: 2361 - protein, 9 aa, Human papillomavirus type 16
TFSPTVPAL

SEQ ID NO: 2362 - protein, 9 aa, Human papillomavirus type 16
VPALLNKCL

SEQ ID NO: 2363 - protein, 10 aa, Human papillomavirus type 16
KFAVDPEPLM

SEQ ID NO: 2364 - protein, 10 aa, Human papillomavirus type 16
AVDPEPLMYK

SEQ ID NO: 2365 - protein, 10 aa, Human papillomavirus type 16
TFSPTVPALL

SEQ ID NO: 2366 - protein, 8 aa, Human papillomavirus type 16
SPYGSDTI

SEQ ID NO: 2367 - protein, 8 aa, Human papillomavirus type 16
YGSDTILI

SEQ ID NO: 2368 - protein, 9 aa, Human papillomavirus type 16
SPYGSDTIL

SEQ ID NO: 2369 - protein, 10 aa, Human papillomavirus type 16
SPYGSDTILI

SEQ ID NO: 2370 - protein, 9 aa, Human papillomavirus type 16
NPDTLGTNI

SEQ ID NO: 2371 - protein, 9 aa, Human papillomavirus type 16
ILLLLGFLI

SEQ ID NO: 2372 - protein, 9 aa, Human papillomavirus type 16
LLLGFLIGK

SEQ ID NO: 2373 - protein, 10 aa, Human papillomavirus type 16
NPDTLGTNIL

SEQ ID NO: 2374 - protein, 10 aa, Human papillomavirus type 16
LLLLGFLIGK

SEQ ID NO: 2375 - protein, 8 aa, Human papillomavirus type 16
YRWVSESG

SEQ ID NO: 2376 - protein, 9 aa, Human papillomavirus type 16
LQYRWVSES

SEQ ID NO: 2377 - protein, 9 aa, Human papillomavirus type 16
YRWVSESGI

SEQ ID NO: 2378 - protein, 10 aa, Human papillomavirus type 16
YRWVSESGII

SEQ ID NO: 2379 - protein, 8 aa, Human papillomavirus type 16
SRCTFCAF

SEQ ID NO: 2380 - protein, 8 aa, Human papillomavirus type 16
CAFCRTFV

SEQ ID NO: 2381 - protein, 8 aa, Human papillomavirus type 16
CRTFVSHC

SEQ ID NO: 2382 - protein, 9 aa, Human papillomavirus type 16
SRCTFCAFC

SEQ ID NO: 2383 - protein, 9 aa, Human papillomavirus type 16
TFCAFCRTF

SEQ ID NO: 2384 - protein, 10 aa, Human papillomavirus type 16
KLGSRCTFCA

SEQ ID NO: 2385 - protein, 10 aa, Human papillomavirus type 16
SRCTFCAFCR

SEQ ID NO: 2386 - protein, 8 aa, Human papillomavirus type 16
LQYTMYNA

SEQ ID NO: 2387 - protein, 9 aa, Human papillomavirus type 16
LQYTMYNAF

SEQ ID NO: 2388 - protein, 8 aa, Human papillomavirus type 16
NALYCICL

SEQ ID NO: 2389 - protein, 8 aa, Human papillomavirus type 16
LHQTALPL

SEQ ID NO: 2390 - protein, 8 aa, Human papillomavirus type 16
HQTALPLY

SEQ ID NO: 2391 - protein, 8 aa, Human papillomavirus type 16
IHVFLYIL

SEQ ID NO: 2392 - protein, 9 aa, Human papillomavirus type 16
NHNSQLDPL

SEQ ID NO: 2393 - protein, 9 aa, Human papillomavirus type 16
SQLDPLPQL

SEQ ID NO: 2394 - protein, 9 aa, Human papillomavirus type 16
DPLPQLLML

SEQ ID NO: 2395 - protein, 9 aa, Human papillomavirus type 16
LLMLLHKYI

SEQ ID NO: 2396 - protein, 9 aa, Human papillomavirus type 16
MLLHKYIYV

SEQ ID NO: 2397 - protein, 9 aa, Human papillomavirus type 16
TALPLYIHV

SEQ ID NO: 2398 - protein, 9 aa, Human papillomavirus type 16
LPLYIHVFL

SEQ ID NO: 2399 - protein, 9 aa, Human papillomavirus type 16
LYIHVFLYI

SEQ ID NO: 2400 - protein, 9 aa, Human papillomavirus type 16
IHVFLYILL

SEQ ID NO: 2401 - protein, 9 aa, Human papillomavirus type 16
FLYILLVQL

SEQ ID NO: 2402 - protein, 9 aa, Human papillomavirus type 16
ILLVQLNTL

SEQ ID NO: 2403 - protein, 10 aa, Human papillomavirus type 16
LMLLHKYIYV

SEQ ID NO: 2404 - protein, 10 aa, Human papillomavirus type 16
IYVSSLYNAL

SEQ ID NO: 2405 - protein, 10 aa, Human papillomavirus type 16
LYNALYCICL

SEQ ID NO: 2406 - protein, 10 aa, Human papillomavirus type 16
ALPLYIHVFL

SEQ ID NO: 2407 - protein, 10 aa, Human papillomavirus type 16
LYIHVFLYIL

SEQ ID NO: 2408 - protein, 10 aa, Human papillomavirus type 16
VFLYILLVQL

SEQ ID NO: 2409 - protein, 10 aa, Human papillomavirus type 16
YILLVQLNTL

SEQ ID NO: 2410 - protein, 8 aa, Human papillomavirus type 16
CPDTHLNV

SEQ ID NO: 2411 - protein, 8 aa, Human papillomavirus type 16
FQFLSLSS

SEQ ID NO: 2412 - protein, 9 aa, Human papillomavirus type 16
LYYHFHNVL

SEQ ID NO: 2413 - protein, 9 aa, Human papillomavirus type 16
LEKKDFQFL

SEQ ID NO: 2414 - protein, 9 aa, Human papillomavirus type 16
FQFLSLSSY

SEQ ID NO: 2415 - protein, 10 aa, Human papillomavirus type 16
YYHFHNVLVF

SEQ ID NO: 2416 - protein, 10 aa, Human papillomavirus type 16
KLNLDHVLEK

SEQ ID NO: 2417 - protein, 10 aa, Human papillomavirus type 16
FQFLSLSSYT

SEQ ID NO: 2418 - protein, 10 aa, Human papillomavirus type 16
FPFSSNGNSL

SEQ ID NO: 2419 - protein, 10 aa, Human papillomavirus type 16
NVNTTNLLCK

SEQ ID NO: 2420 - protein, 8 aa, Human papillomavirus type 16
HQSQHVDL

SEQ ID NO: 2421 - protein, 8 aa, Human papillomavirus type 16
SQHVDLLL

SEQ ID NO: 2422 - protein, 8 aa, Human papillomavirus type 16
QHVDLLLL

SEQ ID NO: 2423 - protein, 8 aa, Human papillomavirus type 16
IAAFALLV

SEQ ID NO: 2424 - protein, 8 aa, Human papillomavirus type 16
WHIVCLSL

SEQ ID NO: 2425 - protein, 8 aa, Human papillomavirus type 16
TPSPPLPL

SEQ ID NO: 2426 - protein, 9 aa, Human papillomavirus type 16
LGVSPNAAI

SEQ ID NO: 2427 - protein, 9 aa, Human papillomavirus type 16
AAIHQSQHV

SEQ ID NO: 2428 - protein, 9 aa, Human papillomavirus type 16
HQSQHVDLL

SEQ ID NO: 2429 - protein, 9 aa, Human papillomavirus type 16
SQHVDLLLL

SEQ ID NO: 2430 - protein, 9 aa, Human papillomavirus type 16
NGLTNSEKL

SEQ ID NO: 2431 - protein, 9 aa, Human papillomavirus type 16
EKLTPYNSL

SEQ ID NO: 2432 - protein, 9 aa, Human papillomavirus type 16
FANIAAFAL

SEQ ID NO: 2433 - protein, 9 aa, Human papillomavirus type 16
ANIAAFALL

SEQ ID NO: 2434 - protein, 9 aa, Human papillomavirus type 16
LLVFSTFKI

SEQ ID NO: 2435 - protein, 9 aa, Human papillomavirus type 16
TPSPPLPLL

SEQ ID NO: 2436 - protein, 10 aa, Human papillomavirus type 16
NAAIHQSQHV

SEQ ID NO: 2437 - protein, 10 aa, Human papillomavirus type 16
IHQSQHVDLL

SEQ ID NO: 2438 - protein, 10 aa, Human papillomavirus type 16
HQSQHVDLLL

SEQ ID NO: 2439 - protein, 10 aa, Human papillomavirus type 16
SEKLTPYNSL

SEQ ID NO: 2440 - protein, 10 aa, Human papillomavirus type 16
NFANIAAFAL

SEQ ID NO: 2441 - protein, 10 aa, Human papillomavirus type 16
FANIAAFALL

SEQ ID NO: 2442 - protein, 10 aa, Human papillomavirus type 16
AFALLVFSTF

SEQ ID NO: 2443 - protein, 10 aa, Human papillomavirus type 16
ALLVFSTFKI

SEQ ID NO: 2444 - protein, 10 aa, Human papillomavirus type 16
LVFSTFKIFV

SEQ ID NO: 2445 - protein, 10 aa, Human papillomavirus type 16
KIFVSGVWHI

SEQ ID NO: 2446 - protein, 8 aa, Human papillomavirus type 16
QPPPLPPL

SEQ ID NO: 2447 - protein, 9 aa, Human papillomavirus type 16
LQPPPLPPL

SEQ ID NO: 2448 - protein, 10 aa, Human papillomavirus type 16
LQPPPLPPLY

SEQ ID NO: 2449 - protein, 8 aa, Human papillomavirus type 16
AALLCFSI

SEQ ID NO: 2450 - protein, 8 aa, Human papillomavirus type 16
IAFNLGLI

SEQ ID NO: 2451 - protein, 8 aa, Human papillomavirus type 16
SGLPNTFV

SEQ ID NO: 2452 - protein, 8 aa, Human papillomavirus type 16
EPVLHLYV

SEQ ID NO: 2453 - protein, 8 aa, Human papillomavirus type 16
LHLYVVLL

SEQ ID NO: 2454 - protein, 9 aa, Human papillomavirus type 16
FAALLCFSI

SEQ ID NO: 2455 - protein, 9 aa, Human papillomavirus type 16
ALLCFSIHI

SEQ ID NO: 2456 - protein, 9 aa, Human papillomavirus type 16
IHIAFNLGL

SEQ ID NO: 2457 - protein, 9 aa, Human papillomavirus type 16
IHIAFNLGL

SEQ ID NO: 2458 - protein, 9 aa, Human papillomavirus type 16
AFNLGLILL

SEQ ID NO: 2459 - protein, 9 aa, Human papillomavirus type 16
HPLISLSGL

SEQ ID NO: 2460 - protein, 9 aa, Human papillomavirus type 16
SLSGLPNTF

SEQ ID NO: 2461 - protein, 9 aa, Human papillomavirus type 16
SGLPNTFVL

SEQ ID NO: 2462 - protein, 9 aa, Human papillomavirus type 16
FVLEPVLHL

SEQ ID NO: 2463 - protein, 9 aa, Human papillomavirus type 16
VLEPVLHLY

SEQ ID NO: 2464 - protein, 9 aa, Human papillomavirus type 16
EPVLHLYVV

SEQ ID NO: 2465 - protein, 10 aa, Human papillomavirus type 16
AALLCFSIHI

SEQ ID NO: 2466 - protein, 10 aa, Human papillomavirus type 16
CFSIHIAFNL

SEQ ID NO: 2467 - protein, 10 aa, Human papillomavirus type 16
IAFNLGLILL

SEQ ID NO: 2468 - protein, 10 aa, Human papillomavirus type 16
THPLISLSGL

SEQ ID NO: 2469 - protein, 10 aa, Human papillomavirus type 16
ISLSGLPNTF

SEQ ID NO: 2470 - protein, 10 aa, Human papillomavirus type 16
SLSGLPNTFV

SEQ ID NO: 2471 - protein, 10 aa, Human papillomavirus type 16
LPNTFVLEPV

SEQ ID NO: 2472 - protein, 10 aa, Human papillomavirus type 16
LPNTFVLEPV

SEQ ID NO: 2473 - protein, 10 aa, Human papillomavirus type 16
EPVLHLYVVL

SEQ ID NO: 2474 - protein, 10 aa, Human papillomavirus type 16
LPVLNNHYHL

SEQ ID NO: 2475 - protein, 8 aa, Human papillomavirus type 16
IHYIPYPL

SEQ ID NO: 2476 - protein, 8 aa, Human papillomavirus type 16
YPLPHWYL

SEQ ID NO: 2477 - protein, 9 aa, Human papillomavirus type 16
LFFFPLQPL

SEQ ID NO: 2478 - protein, 9 aa, Human papillomavirus type 16
FPLQPLHKT

SEQ ID NO: 2479 - protein, 10 aa, Human papillomavirus type 16
FPLQPLHKTI

SEQ ID NO: 2480 - protein, 10 aa, Human papillomavirus type 16
LQPLHKTIHY

SEQ ID NO: 2481 - protein, 10 aa, Human papillomavirus type 16
QPLHKTIHYI

SEQ ID NO: 2482 - protein, 10 aa, Human papillomavirus type 16
IPYPLPHWYL

SEQ ID NO: 2483 - protein, 8 aa, Human papillomavirus type 16
HLFHPPPL

SEQ ID NO: 2484 - protein, 8 aa, Human papillomavirus type 16
PPLSCHLI

SEQ ID NO: 2485 - protein, 8 aa, Human papillomavirus type 16
SRDQLSLV

SEQ ID NO: 2486 - protein, 9 aa, Human papillomavirus type 16
DHLFHPPPL

SEQ ID NO: 2487 - protein, 9 aa, Human papillomavirus type 16
HPPPLSCHL

SEQ ID NO: 2488 - protein, 9 aa, Human papillomavirus type 16
SRDQLSLVA

SEQ ID NO: 2489 - protein, 9 aa, Human papillomavirus type 16
SLVANLTYI

SEQ ID NO: 2490 - protein, 10 aa, Human papillomavirus type 16
HPPPLSCHLI

SEQ ID NO: 2491 - protein, 10 aa, Human papillomavirus type 16
SRDQLSLVAN

SEQ ID NO: 2492 - protein, 8 aa, Human papillomavirus type 16
FGYALSFI

SEQ ID NO: 2493 - protein, 9 aa, Human papillomavirus type 16
WVLKHCSSL

SEQ ID NO: 2494 - protein, 9 aa, Human papillomavirus type 16
YALSFIHEL

SEQ ID NO: 2495 - protein, 10 aa, Human papillomavirus type 16
WVLKHCSSLL

SEQ ID NO: 2496 - protein, 10 aa, Human papillomavirus type 16
ILTGFGSTDF

SEQ ID NO: 2497 - protein, 10 aa, Human papillomavirus type 16
TDFGYALSFI

SEQ ID NO: 2498 - protein, 10 aa, Human papillomavirus type 16
GYALSFIHEL

SEQ ID NO: 2499 - protein, 10 aa, Human papillomavirus type 16
YALSFIHELL

SEQ ID NO: 2500 - protein, 9 aa, Human papillomavirus type 16
CAVLQMNNV

SEQ ID NO: 2501 - protein, 8 aa, Human papillomavirus type 16
KALAHSDL

SEQ ID NO: 2502 - protein, 10 aa, Human papillomavirus type 16
ALAHSDLFYM

SEQ ID NO: 2503 - protein, 8 aa, Human papillomavirus type 16
CRSGKQGF

SEQ ID NO: 2504 - protein, 8 aa, Human papillomavirus type 16
KQETYKFK

SEQ ID NO: 2505 - protein, 9 aa, Human papillomavirus type 16
KQGFGTHGK

SEQ ID NO: 2506 - protein, 10 aa, Human papillomavirus type 16
MVGKQCRSGK

SEQ ID NO: 2507 - protein, 10 aa, Human papillomavirus type 16
KQCRSGKQGF

SEQ ID NO: 2508 - protein, 10 aa, Human papillomavirus type 16
CRSGKQGFGT

SEQ ID NO: 2509 - protein, 8 aa, Human papillomavirus type 16
AAHNDIFV

SEQ ID NO: 2510 - protein, 8 aa, Human papillomavirus type 16
AHNDIFVL

SEQ ID NO: 2511 - protein, 9 aa, Human papillomavirus type 16
MAAHNDIFV

SEQ ID NO: 2512 - protein, 10 aa, Human papillomavirus type 16
FVLRVVSTTV

SEQ ID NO: 2513 - protein, 8 aa, Human papillomavirus type 16
VRATYSSV

SEQ ID NO: 2514 - protein, 9 aa, Human papillomavirus type 16
VRATYSSVL

SEQ ID NO: 2515 - protein, 9 aa, Human papillomavirus type 16
TYSSVLTTL

SEQ ID NO: 2516 - protein, 10 aa, Human papillomavirus type 16
FVRATYSSVL

SEQ ID NO: 2517 - protein, 10 aa, Human papillomavirus type 16
VRATYSSVLT

SEQ ID NO: 2518 - protein, 8 aa, Human papillomavirus type 16
YRFSTTST

SEQ ID NO: 2519 - protein, 9 aa, Human papillomavirus type 16
YLSTYRFST

SEQ ID NO: 2520 - protein, 8 aa, Human papillomavirus type 16
CRCWRLQY

SEQ ID NO: 2521 - protein, 8 aa, Human papillomavirus type 16
WRLQYRWV

SEQ ID NO: 2522 - protein, 9 aa, Human papillomavirus type 16
CRCWRLQYR

SEQ ID NO: 2523 - protein, 9 aa, Human papillomavirus type 16
WRLQYRWVS

SEQ ID NO: 2524 - protein, 10 aa, Human papillomavirus type 16
CRCWRLQYRW

SEQ ID NO: 2525 - protein, 8 aa, Human papillomavirus type 16
LPQLLMLL

SEQ ID NO: 2526 - protein, 10 aa, Human papillomavirus type 16
SQLDPLPQLL

SEQ ID NO: 2527 - protein, 10 aa, Human papillomavirus type 16
LDPLPQLLML

SEQ ID NO: 2528 - protein, 10 aa, Human papillomavirus type 16
DPLPQLLMLL

SEQ ID NO: 2529 - protein, 10 aa, Human papillomavirus type 16
QLLMLLHKYI

SEQ ID NO: 2530 - protein, 8 aa, Human papillomavirus type 16
VQLLVMLY

SEQ ID NO: 2531 - protein, 8 aa, Human papillomavirus type 16
IQPVLAPL

SEQ ID NO: 2532 - protein, 9 aa, Human papillomavirus type 16
HYYIVSYIL

SEQ ID NO: 2533 - protein, 9 aa, Human papillomavirus type 16
YYIVSYILF

SEQ ID NO: 2534 - protein, 9 aa, Human papillomavirus type 16
YIVSYILFL

SEQ ID NO: 2535 - protein, 9 aa, Human papillomavirus type 16
VSYILFLTL

SEQ ID NO: 2536 - protein, 9 aa, Human papillomavirus type 16
ILFLTLVAV

SEQ ID NO: 2537 - protein, 9 aa, Human papillomavirus type 16
VAVQLLVML

SEQ ID NO: 2538 - protein, 9 aa, Human papillomavirus type 16
QLLVMLYSL

SEQ ID NO: 2539 - protein, 9 aa, Human papillomavirus type 16
MLYSLIQPV

SEQ ID NO: 2540 - protein, 9 aa, Human papillomavirus type 16
LYSLIQPVL

SEQ ID NO: 2541 - protein, 10 aa, Human papillomavirus type 16
FHYYIVSYIL

SEQ ID NO: 2542 - protein, 10 aa, Human papillomavirus type 16
HYYIVSYILF

SEQ ID NO: 2543 - protein, 10 aa, Human papillomavirus type 16
YYIVSYILFL

SEQ ID NO: 2544 - protein, 10 aa, Human papillomavirus type 16
YILFLTLVAV

SEQ ID NO: 2545 - protein, 10 aa, Human papillomavirus type 16
LFLTLVAVQL

SEQ ID NO: 2546 - protein, 10 aa, Human papillomavirus type 16
FLTLVAVQLL

SEQ ID NO: 2547 - protein, 10 aa, Human papillomavirus type 16
VQLLVMLYSL

SEQ ID NO: 2548 - protein, 10 aa, Human papillomavirus type 16
VMLYSLIQPV

SEQ ID NO: 2549 - protein, 10 aa, Human papillomavirus type 16
MLYSLIQPVL

SEQ ID NO: 2550 - protein, 8 aa, Human papillomavirus type 16
NGLCFTSI

SEQ ID NO: 2551 - protein, 9 aa, Human papillomavirus type 16
GHFSCTNGL

SEQ ID NO: 2552 - protein, 9 aa, Human papillomavirus type 16
CFTSIETKF

SEQ ID NO: 2553 - protein, 9 aa, Human papillomavirus type 16
FPSNAFLKL

SEQ ID NO: 2554 - protein, 10 aa, Human papillomavirus type 16
HFSCTNGLCF

SEQ ID NO: 2555 - protein, 10 aa, Human papillomavirus type 16
KFPSNAFLKL

SEQ ID NO: 2556 - protein, 9 aa, Human papillomavirus type 16
MQFFLGMPC

SEQ ID NO: 2557 - protein, 10 aa, Human papillomavirus type 16
MQFFLGMPCK

SEQ ID NO: 2558 - protein, 10 aa, Human papillomavirus type 16
FFLGMPCKNL

SEQ ID NO: 2559 - protein, 10 aa, Human papillomavirus type 16
MPCKNLFNAV

SEQ ID NO: 2560 - protein, 8 aa, Human papillomavirus type 16
KQYCCNSV

SEQ ID NO: 2561 - protein, 9 aa, Human papillomavirus type 16
KQYCCNSVF

SEQ ID NO: 2562 - protein, 9 aa, Human papillomavirus type 16
FILSAILGV

SEQ ID NO: 2563 - protein, 9 aa, Human papillomavirus type 16
ANIAAFALL

SEQ ID NO: 2564 - protein, 10 aa, Human papillomavirus type 16
KQYCCNSVFI

SEQ ID NO: 2565 - protein, 10 aa, Human papillomavirus type 16
QYCCNSVFIL

SEQ ID NO: 2566 - protein, 8 aa, Human papillomavirus type 16
NRWGTQFL

SEQ ID NO: 2567 - protein, 8 aa, Human papillomavirus type 16
TQFLVCPL

SEQ ID NO: 2568 - protein, 9 aa, Human papillomavirus type 16
NRWGTQFLV

SEQ ID NO: 2569 - protein, 9 aa, Human papillomavirus type 16
TQFLVCPLT

SEQ ID NO: 2570 - protein, 9 aa, Human papillomavirus type 16
FLVCPLTGL

SEQ ID NO: 2571 - protein, 9 aa, Human papillomavirus type 16
TGLPKYECL

SEQ ID NO: 2572 - protein, 9 aa, Human papillomavirus type 16
LPKYECLRV

SEQ ID NO: 2573 - protein, 9 aa, Human papillomavirus type 16
KYECLRVCF

SEQ ID NO: 2574 - protein, 10 aa, Human papillomavirus type 16
SENRWGTQFL

SEQ ID NO: 2575 - protein, 10 aa, Human papillomavirus type 16
NRWGTQFLVC

SEQ ID NO: 2576 - protein, 10 aa, Human papillomavirus type 16
QFLVCPLTGL

SEQ ID NO: 2577 - protein, 10 aa, Human papillomavirus type 16
LVCPLTGLPK

SEQ ID NO: 2578 - protein, 8 aa, Human papillomavirus type 16
LLFVQMSL

SEQ ID NO: 2579 - protein, 8 aa, Human papillomavirus type 16
VQMSLLFF

SEQ ID NO: 2580 - protein, 8 aa, Human papillomavirus type 16
FRTQWLLT

SEQ ID NO: 2581 - protein, 8 aa, Human papillomavirus type 16
TQWLLTVN

SEQ ID NO: 2582 - protein, 9 aa, Human papillomavirus type 16
LLFVQMSLL

SEQ ID NO: 2583 - protein, 9 aa, Human papillomavirus type 16
LFVQMSLLF

SEQ ID NO: 2584 - protein, 9 aa, Human papillomavirus type 16
VQMSLLFFR

SEQ ID NO: 2585 - protein, 9 aa, Human papillomavirus type 16
LLFFRTQWL

SEQ ID NO: 2586 - protein, 9 aa, Human papillomavirus type 16
LFFRTQWLL

SEQ ID NO: 2587 - protein, 9 aa, Human papillomavirus type 16
FRTQWLLTV

SEQ ID NO: 2588 - protein, 9 aa, Human papillomavirus type 16
TQWLLTVNT

SEQ ID NO: 2589 - protein, 10 aa, Human papillomavirus type 16
SLLFVQMSLL

SEQ ID NO: 2590 - protein, 10 aa, Human papillomavirus type 16
LFVQMSLLFF

SEQ ID NO: 2591 - protein, 10 aa, Human papillomavirus type 16
FVQMSLLFFR

SEQ ID NO: 2592 - protein, 10 aa, Human papillomavirus type 16
MSLLFFRTQW

SEQ ID NO: 2593 - protein, 10 aa, Human papillomavirus type 16
SLLFFRTQWL

SEQ ID NO: 2594 - protein, 10 aa, Human papillomavirus type 16
LLFFRTQWLL

SEQ ID NO: 2595 - protein, 10 aa, Human papillomavirus type 16
FRTQWLLTVN

SEQ ID NO: 2596 - protein, 9 aa, Human papillomavirus type 16
ILTNFRIKL

SEQ ID NO: 2597 - protein, 8 aa, Human papillomavirus type 16
LQNIVYIK

SEQ ID NO: 2598 - protein, 8 aa, Human papillomavirus type 16
KQDVANIV

SEQ ID NO: 2599 - protein, 9 aa, Human papillomavirus type 16
LALQNIVYI

SEQ ID NO: 2600 - protein, 9 aa, Human papillomavirus type 16
ALQNIVYIK

SEQ ID NO: 2601 - protein, 9 aa, Human papillomavirus type 16
KQKQDVANI

SEQ ID NO: 2602 - protein, 9 aa, Human papillomavirus type 16
KQDVANIVY

SEQ ID NO: 2603 - protein, 10 aa, Human papillomavirus type 16
KQKQDVANIV

SEQ ID NO: 2604 - protein, 10 aa, Human papillomavirus type 16
KQDVANIVYI

SEQ ID NO: 2605 - protein, 8 aa, Human papillomavirus type 16
KTFPLNLL

SEQ ID NO: 2606 - protein, 9 aa, Human papillomavirus type 16
LVVKICVLK

SEQ ID NO: 2607 - protein, 9 aa, Human papillomavirus type 16
LQKTFPLNL

SEQ ID NO: 2608 - protein, 10 aa, Human papillomavirus type 16
LQKTFPLNLL

SEQ ID NO: 2609 - protein, 10 aa, Human papillomavirus type 16
KTFPLNLLPK

SEQ ID NO: 2610 - protein, 10 aa, Human papillomavirus type 16
FPLNLLPKKC

SEQ ID NO: 2611 - protein, 8 aa, Human papillomavirus type 16
LQTYKYLL

SEQ ID NO: 2612 - protein, 9 aa, Human papillomavirus type 16
VFDKQLPGL

SEQ ID NO: 2613 - protein, 9 aa, Human papillomavirus type 16
KQLPGLQTY

SEQ ID NO: 2614 - protein, 9 aa, Human papillomavirus type 16
TYKYLLVCL

SEQ ID NO: 2615 - protein, 10 aa, Human papillomavirus type 16
LEVYVFDKQL

SEQ ID NO: 2616 - protein, 10 aa, Human papillomavirus type 16
YVFDKQLPGL

SEQ ID NO: 2617 - protein, 10 aa, Human papillomavirus type 16
KQLPGLQTYK

SEQ ID NO: 2618 - protein, 10 aa, Human papillomavirus type 16
LPGLQTYKYL

SEQ ID NO: 2619 - protein, 10 aa, Human papillomavirus type 16
GLQTYKYLLV

SEQ ID NO: 2620 - protein, 10 aa, Human papillomavirus type 16
TYKYLLVCLL

SEQ ID NO: 2621 - protein, 10 aa, Human papillomavirus type 16
YLLVCLLGEV

SEQ ID NO: 2622 - protein, 10 aa, Human papillomavirus type 16
VVDQNSSPPK

SEQ ID NO: 2623 - protein, 8 aa, Human papillomavirus type 16
RLFCTVEK

SEQ ID NO: 2624 - protein, 9 aa, Human papillomavirus type 16
LRLFCTVEK

SEQ ID NO: 2625 - protein, 8 aa, Human papillomavirus type 16
QHWYMGIL

SEQ ID NO: 2626 - protein, 8 aa, Human papillomavirus type 16
MGILCPSV

SEQ ID NO: 2627 - protein, 9 aa, Human papillomavirus type 16
LMVDNHLDL

SEQ ID NO: 2628 - protein, 9 aa, Human papillomavirus type 16
LQHWYMGIL

SEQ ID NO: 2629 - protein, 9 aa, Human papillomavirus type 16
YMGILCPSV

SEQ ID NO: 2630 - protein, 10 aa, Human papillomavirus type 16
LMVDNHLDLL

SEQ ID NO: 2631 - protein, 8 aa, Human papillomavirus type 16
MRCQENQT

SEQ ID NO: 2632 - protein, 9 aa, Human papillomavirus type 16
MRCQENQTY

SEQ ID NO: 2633 - protein, 9 aa, Human papillomavirus type 16
TYWGQVNVF

SEQ ID NO: 2634 - protein, 10 aa, Human papillomavirus type 16
MRCQENQTYW

SEQ ID NO: 2635 - protein, 8 aa, Human papillomavirus type 16
LQVVWMFL

SEQ ID NO: 2636 - protein, 8 aa, Human papillomavirus type 16
VQHIHPCL

SEQ ID NO: 2637 - protein, 9 aa, Human papillomavirus type 16
MFLHDNICL

SEQ ID NO: 2638 - protein, 9 aa, Human papillomavirus type 16
FLHDNICLC

SEQ ID NO: 2639 - protein, 10 aa, Human papillomavirus type 16
WMFLHDNICL

SEQ ID NO: 2640 - protein, 10 aa, Human papillomavirus type 16
FLHDNICLCV

SEQ ID NO: 2641 - protein, 8 aa, Human papillomavirus type 16
AGLCKATI

SEQ ID NO: 2642 - protein, 8 aa, Human papillomavirus type 16
YAGLSYVI

SEQ ID NO: 2643 - protein, 8 aa, Human papillomavirus type 16
VRLYNPRR

SEQ ID NO: 2644 - protein, 8 aa, Human papillomavirus type 16
GRDPGMGV

SEQ ID NO: 2645 - protein, 8 aa, Human papillomavirus type 16
DPGMGVLL

SEQ ID NO: 2646 - protein, 8 aa, Human papillomavirus type 16
MGVLLVTV

SEQ ID NO: 2647 - protein, 9 aa, Human papillomavirus type 16
YLMPVRLEV

SEQ ID NO: 2648 - protein, 9 aa, Human papillomavirus type 16
VRLEVNAGL

SEQ ID NO: 2649 - protein, 9 aa, Human papillomavirus type 16
NAGLCKATI

SEQ ID NO: 2650 - protein, 9 aa, Human papillomavirus type 16
GLCKATISK

SEQ ID NO: 2651 - protein, 9 aa, Human papillomavirus type 16
GAILILLSL

SEQ ID NO: 2652 - protein, 9 aa, Human papillomavirus type 16
ILLSLLEKY

SEQ ID NO: 2653 - protein, 9 aa, Human papillomavirus type 16
SLLEKYNVL

SEQ ID NO: 2654 - protein, 9 aa, Human papillomavirus type 16
KYNVLSTSI

SEQ ID NO: 2655 - protein, 9 aa, Human papillomavirus type 16
TSIPSYAGL

SEQ ID NO: 2656 - protein, 9 aa, Human papillomavirus type 16
GLSYVISLV

SEQ ID NO: 2657 - protein, 9 aa, Human papillomavirus type 16
TTLTCCVVR

SEQ ID NO: 2658 - protein, 9 aa, Human papillomavirus type 16
CVVRLYNPR

SEQ ID NO: 2659 - protein, 9 aa, Human papillomavirus type 16
VVRLYNPRR

SEQ ID NO: 2660 - protein, 9 aa, Human papillomavirus type 16
GRDPGMGVL

SEQ ID NO: 2661 - protein, 9 aa, Human papillomavirus type 16
RDPGMGVLL

SEQ ID NO: 2662 - protein, 9 aa, Human papillomavirus type 16
DPGMGVLLV

SEQ ID NO: 2663 - protein, 9 aa, Human papillomavirus type 16
GMGVLLVTV

SEQ ID NO: 2664 - protein, 9 aa, Human papillomavirus type 16
LLVTVLGFV

SEQ ID NO: 2665 - protein, 9 aa, Human papillomavirus type 16
LGFVLTINV

SEQ ID NO: 2666 - protein, 10 aa, Human papillomavirus type 16
VRLEVNAGLC

SEQ ID NO: 2667 - protein, 10 aa, Human papillomavirus type 16
GAILILLSLL

SEQ ID NO: 2668 - protein, 10 aa, Human papillomavirus type 16
LLSLLEKYNV

SEQ ID NO: 2669 - protein, 10 aa, Human papillomavirus type 16
LSLLEKYNVL

SEQ ID NO: 2670 - protein, 10 aa, Human papillomavirus type 16
IPSYAGLSYV

SEQ ID NO: 2671 - protein, 10 aa, Human papillomavirus type 16
YAGLSYVISL

SEQ ID NO: 2672 - protein, 10 aa, Human papillomavirus type 16
AGLSYVISLV

SEQ ID NO: 2673 - protein, 10 aa, Human papillomavirus type 16
CVVRLYNPRR

SEQ ID NO: 2674 - protein, 10 aa, Human papillomavirus type 16
RRATGRDPGM

SEQ ID NO: 2675 - protein, 10 aa, Human papillomavirus type 16
GRDPGMGVLL

SEQ ID NO: 2676 - protein, 10 aa, Human papillomavirus type 16
VLLVTVLGFV

SEQ ID NO: 2677 - protein, 10 aa, Human papillomavirus type 16
VLGFVLTINV

SEQ ID NO: 2678 - protein, 8 aa, Human papillomavirus type 16
SRLCFFGA

SEQ ID NO: 2679 - protein, 8 aa, Human papillomavirus type 16
GQVLPNNF

SEQ ID NO: 2680 - protein, 8 aa, Human papillomavirus type 16
FRRGYFVA

SEQ ID NO: 2681 - protein, 8 aa, Human papillomavirus type 16
RRGYFVAA

SEQ ID NO: 2682 - protein, 9 aa, Human papillomavirus type 16
FFGAQGDGF

SEQ ID NO: 2683 - protein, 9 aa, Human papillomavirus type 16
GRGGVVGQV

SEQ ID NO: 2684 - protein, 9 aa, Human papillomavirus type 16
QVLPNNFRR

SEQ ID NO: 2685 - protein, 9 aa, Human papillomavirus type 16
FRRGYFVAA

SEQ ID NO: 2686 - protein, 9 aa, Human papillomavirus type 16
RRGYFVAAK

SEQ ID NO: 2687 - protein, 9 aa, Human papillomavirus type 16
FVAAKHRCR

SEQ ID NO: 2688 - protein, 10 aa, Human papillomavirus type 16
CFFGAQGDGF

SEQ ID NO: 2689 - protein, 10 aa, Human papillomavirus type 16
AQGDGFGMGR

SEQ ID NO: 2690 - protein, 10 aa, Human papillomavirus type 16
DGFGMGRGGV

SEQ ID NO: 2691 - protein, 10 aa, Human papillomavirus type 16
GRGGVVGQVL

SEQ ID NO: 2692 - protein, 10 aa, Human papillomavirus type 16
GQVLPNNFRR

SEQ ID NO: 2693 - protein, 10 aa, Human papillomavirus type 16
FRRGYFVAAK

SEQ ID NO: 2694 - protein, 10 aa, Human papillomavirus type 16
RRGYFVAAKH

SEQ ID NO: 2695 - protein, 8 aa, Human papillomavirus type 16
TRMNFPYF

SEQ ID NO: 2696 - protein, 8 aa, Human papillomavirus type 16
FPYFIFTI

SEQ ID NO: 2697 - protein, 9 aa, Human papillomavirus type 16
TRMNFPYFI

SEQ ID NO: 2698 - protein, 9 aa, Human papillomavirus type 16
FPYFIFTIF

SEQ ID NO: 2699 - protein, 9 aa, Human papillomavirus type 16
FIFTIFFCI

SEQ ID NO: 2700 - protein, 9 aa, Human papillomavirus type 16
IFFCIIFKL

SEQ ID NO: 2701 - protein, 10 aa, Human papillomavirus type 16
TRMNFPYFIF

SEQ ID NO: 2702 - protein, 10 aa, Human papillomavirus type 16
NFPYFIFTIF

SEQ ID NO: 2703 - protein, 10 aa, Human papillomavirus type 16
IFTIFFCIIF

SEQ ID NO: 2704 - protein, 10 aa, Human papillomavirus type 16
TIFFCIIFKL

SEQ ID NO: 2705 - protein, 9 aa, Human papillomavirus type 16
HFHCISMFF

SEQ ID NO: 2706 - protein, 10 aa, Human papillomavirus type 16
ISMFFYTSCW

SEQ ID NO: 2707 - protein, 8 aa, Human papillomavirus type 16
FRFRQMET

SEQ ID NO: 2708 - protein, 9 aa, Human papillomavirus type 16
FRFRQMETH

SEQ ID NO: 2709 - protein, 8 aa, Human papillomavirus type 16
NPLQFLPV

SEQ ID NO: 2710 - protein, 8 aa, Human papillomavirus type 16
LQFLPVNY

SEQ ID NO: 2711 - protein, 9 aa, Human papillomavirus type 16
LVYNVYTLL

SEQ ID NO: 2712 - protein, 9 aa, Human papillomavirus type 16
VYTLLHNPL

SEQ ID NO: 2713 - protein, 9 aa, Human papillomavirus type 16
LLHNPLQFL

SEQ ID NO: 2714 - protein, 9 aa, Human papillomavirus type 16
LQFLPVNYF

SEQ ID NO: 2715 - protein, 9 aa, Human papillomavirus type 16
QFLPVNYFL

SEQ ID NO: 2716 - protein, 10 aa, Human papillomavirus type 16
LLVYNVYTLL

SEQ ID NO: 2717 - protein, 10 aa, Human papillomavirus type 16
TLLHNPLQFL

SEQ ID NO: 2718 - protein, 10 aa, Human papillomavirus type 16
LQFLPVNYFL

SEQ ID NO: 2719 - protein, 8 aa, Human papillomavirus type 16
YRLLCHYR

SEQ ID NO: 2720 - protein, 8 aa, Human papillomavirus type 16
YRLLCHYR

SEQ ID NO: 2721 - protein, 8 aa, Human papillomavirus type 16
YRRPIVPS

SEQ ID NO: 2722 - protein, 8 aa, Human papillomavirus type 16
RRPIVPSV

SEQ ID NO: 2723 - protein, 8 aa, Human papillomavirus type 16
RPIVPSVI

SEQ ID NO: 2724 - protein, 9 aa, Human papillomavirus type 16
IYMQFHYRL

SEQ ID NO: 2725 - protein, 9 aa, Human papillomavirus type 16
MQFHYRLLC

SEQ ID NO: 2726 - protein, 9 aa, Human papillomavirus type 16
YRLLCHYRR

SEQ ID NO: 2727 - protein, 9 aa, Human papillomavirus type 16
YRRPIVPSV

SEQ ID NO: 2728 - protein, 9 aa, Human papillomavirus type 16
RRPIVPSVI

SEQ ID NO: 2729 - protein, 9 aa, Human papillomavirus type 16
RPIVPSVII

SEQ ID NO: 2730 - protein, 10 aa, Human papillomavirus type 16
IYMQFHYRLL

SEQ ID NO: 2731 - protein, 10 aa, Human papillomavirus type 16
MQFHYRLLCH

SEQ ID NO: 2732 - protein, 10 aa, Human papillomavirus type 16
YRRPIVPSVI

SEQ ID NO: 2733 - protein, 10 aa, Human papillomavirus type 16
RRPIVPSVII

SEQ ID NO: 2734 - protein, 9 aa, Human papillomavirus type 16
VFVSILACL

SEQ ID NO: 2735 - protein, 10 aa, Human papillomavirus type 16
FVFVSILACL

SEQ ID NO: 2736 - protein, 8 aa, Human papillomavirus type 16
EALSSYTL

SEQ ID NO: 2737 - protein, 9 aa, Human papillomavirus type 16
LFYTNIMLL

SEQ ID NO: 2738 - protein, 9 aa, Human papillomavirus type 16
FYTNIMLLL

SEQ ID NO: 2739 - protein, 9 aa, Human papillomavirus type 16
MLLLYYAIL

SEQ ID NO: 2740 - protein, 9 aa, Human papillomavirus type 16
LYYAILEAL

SEQ ID NO: 2741 - protein, 9 aa, Human papillomavirus type 16
LEALSSYTL

SEQ ID NO: 2742 - protein, 10 aa, Human papillomavirus type 16
LFYTNIMLLL

SEQ ID NO: 2743 - protein, 10 aa, Human papillomavirus type 16
IMLLLYYAIL

SEQ ID NO: 2744 - protein, 10 aa, Human papillomavirus type 16
LLYYAILEAL

SEQ ID NO: 2745 - protein, 8 aa, Human papillomavirus type 16
QRMCCLCF

SEQ ID NO: 2746 - protein, 9 aa, Human papillomavirus type 16
MLFCFLCSK

SEQ ID NO: 2747 - protein, 9 aa, Human papillomavirus type 16
CFLCSKQRM

SEQ ID NO: 2748 - protein, 9 aa, Human papillomavirus type 16
KQRMCCLCF

SEQ ID NO: 2749 - protein, 9 aa, Human papillomavirus type 16
QRMCCLCFC

SEQ ID NO: 2750 - protein, 9 aa, Human papillomavirus type 16
RMCCLCFCL

SEQ ID NO: 2751 - protein, 10 aa, Human papillomavirus type 16
LYCISMLFCF

SEQ ID NO: 2752 - protein, 10 aa, Human papillomavirus type 16
YCISMLFCFL

SEQ ID NO: 2753 - protein, 10 aa, Human papillomavirus type 16
SMLFCFLCSK

SEQ ID NO: 2754 - protein, 10 aa, Human papillomavirus type 16
QRMCCLCFCL

SEQ ID NO: 2755 - protein, 8 aa, Human papillomavirus type 16
LRTDGAHN

SEQ ID NO: 2756 - protein, 9 aa, Human papillomavirus type 16
LRTDGAHNS

SEQ ID NO: 2757 - protein, 8 aa, Human papillomavirus type 16
HRPVHRPL

SEQ ID NO: 2758 - protein, 8 aa, Human papillomavirus type 16
RPVHRPLI

SEQ ID NO: 2759 - protein, 8 aa, Human papillomavirus type 16
HRPLILWN

SEQ ID NO: 2760 - protein, 8 aa, Human papillomavirus type 16
RPLILWNL

SEQ ID NO: 2761 - protein, 8 aa, Human papillomavirus type 16
ILWNLCFL

SEQ ID NO: 2762 - protein, 8 aa, Human papillomavirus type 16
SRCLCFSS

SEQ ID NO: 2763 - protein, 9 aa, Human papillomavirus type 16
HRPVHRPLI

SEQ ID NO: 2764 - protein, 9 aa, Human papillomavirus type 16
RPVHRPLIL

SEQ ID NO: 2765 - protein, 9 aa, Human papillomavirus type 16
HRPLILWNL

SEQ ID NO: 2766 - protein, 9 aa, Human papillomavirus type 16
LILWNLCFL

SEQ ID NO: 2767 - protein, 9 aa, Human papillomavirus type 16
CFLSRCLCF

SEQ ID NO: 2768 - protein, 9 aa, Human papillomavirus type 16
CFSSGHSGF

SEQ ID NO: 2769 - protein, 10 aa, Human papillomavirus type 16
QQDIHRPVHR

SEQ ID NO: 2770 - protein, 10 aa, Human papillomavirus type 16
HRPVHRPLIL

SEQ ID NO: 2771 - protein, 10 aa, Human papillomavirus type 16
HRPLILWNLC

SEQ ID NO: 2772 - protein, 10 aa, Human papillomavirus type 16
ILWNLCFLSR

SEQ ID NO: 2773 - protein, 10 aa, Human papillomavirus type 16
SRCLCFSSGH

SEQ ID NO: 2774 - protein, 8 aa, Human papillomavirus type 16
NRDLARMA

SEQ ID NO: 2775 - protein, 8 aa, Human papillomavirus type 16
ARMASRKR

SEQ ID NO: 2776 - protein, 8 aa, Human papillomavirus type 16
SRKRTSLN

SEQ ID NO: 2777 - protein, 8 aa, Human papillomavirus type 16
KRTSLNHS

SEQ ID NO: 2778 - protein, 9 aa, Human papillomavirus type 16
GQENRDLAR

SEQ ID NO: 2779 - protein, 9 aa, Human papillomavirus type 16
NRDLARMAS

SEQ ID NO: 2780 - protein, 9 aa, Human papillomavirus type 16
SRKRTSLNH

SEQ ID NO: 2781 - protein, 9 aa, Human papillomavirus type 16
KRTSLNHSC

SEQ ID NO: 2782 - protein, 10 aa, Human papillomavirus type 16
NRDLARMASR

SEQ ID NO: 2783 - protein, 10 aa, Human papillomavirus type 16
RMASRKRTSL

SEQ ID NO: 2784 - protein, 10 aa, Human papillomavirus type 16
SRKRTSLNHS

SEQ ID NO: 2785 - protein, 8 aa, Human papillomavirus type 16
MGLALQNI

SEQ ID NO: 2786 - protein, 9 aa, Human papillomavirus type 16
MGLALQNIV

SEQ ID NO: 2787 - protein, 10 aa, Human papillomavirus type 16
GLALQNIVYI

SEQ ID NO: 2788 - protein, 8 aa, Human papillomavirus type 16
TQAFKNTY

SEQ ID NO: 2789 - protein, 8 aa, Human papillomavirus type 16
TRVYYTIH

SEQ ID NO: 2790 - protein, 9 aa, Human papillomavirus type 16
DTIVTQAFK

SEQ ID NO: 2791 - protein, 9 aa, Human papillomavirus type 16
TRVYYTIHT

SEQ ID NO: 2792 - protein, 10 aa, Human papillomavirus type 16
LHDTIVTQAF

SEQ ID NO: 2793 - protein, 10 aa, Human papillomavirus type 16
TQAFKNTYTR

SEQ ID NO: 2794 - protein, 10 aa, Human papillomavirus type 16
QAFKNTYTRV

SEQ ID NO: 2795 - protein, 10 aa, Human papillomavirus type 16
TRVYYTIHTN

SEQ ID NO: 2796 - protein, 10 aa, Human papillomavirus type 16
MYKYPVELHF

SEQ ID NO: 2797 - protein, 8 aa, Human papillomavirus type 16
DHDLPQHL

SEQ ID NO: 2798 - protein, 8 aa, Human papillomavirus type 16
HRPKPAAV

SEQ ID NO: 2799 - protein, 8 aa, Human papillomavirus type 16
RPKPAAVY

SEQ ID NO: 2800 - protein, 9 aa, Human papillomavirus type 16
HRPKPAAVY

SEQ ID NO: 2801 - protein, 9 aa, Human papillomavirus type 16
RPKPAAVYL

SEQ ID NO: 2802 - protein, 9 aa, Human papillomavirus type 16
KPAAVYLDY

SEQ ID NO: 2803 - protein, 9 aa, Human papillomavirus type 16
AVYLDYKMR

SEQ ID NO: 2804 - protein, 10 aa, Human papillomavirus type 16
HRPKPAAVYL

SEQ ID NO: 2805 - protein, 8 aa, Human papillomavirus type 16
YAPPKGIV

SEQ ID NO: 2806 - protein, 8 aa, Human papillomavirus type 16
APPKGIVV

SEQ ID NO: 2807 - protein, 9 aa, Human papillomavirus type 16
YAPPKGIVV

SEQ ID NO: 2808 - protein, 9 aa, Human papillomavirus type 16
KGIVVFAGI

SEQ ID NO: 2809 - protein, 8 aa, Human papillomavirus type 16
APASIKLV

SEQ ID NO: 2810 - protein, 8 aa, Human papillomavirus type 16
GGLTGASV

SEQ ID NO: 2811 - protein, 8 aa, Human papillomavirus type 16
GASVSVAV

SEQ ID NO: 2812 - protein, 8 aa, Human papillomavirus type 16
GGLVPNGI

SEQ ID NO: 2813 - protein, 8 aa, Human papillomavirus type 16
VPNGIYPV

SEQ ID NO: 2814 - protein, 8 aa, Human papillomavirus type 16
RPPVPDPV

SEQ ID NO: 2815 - protein, 8 aa, Human papillomavirus type 16
NPPKNTPI

SEQ ID NO: 2816 - protein, 8 aa, Human papillomavirus type 16
VPACLHVL

SEQ ID NO: 2817 - protein, 9 aa, Human papillomavirus type 16
DVGAPASIK

SEQ ID NO: 2818 - protein, 9 aa, Human papillomavirus type 16
GAPASIKLV

SEQ ID NO: 2819 - protein, 9 aa, Human papillomavirus type 16
VRPPVPDPV

SEQ ID NO: 2820 - protein, 9 aa, Human papillomavirus type 16
PPVPDPVPI

SEQ ID NO: 2821 - protein, 9 aa, Human papillomavirus type 16
NPPKNTPIL

SEQ ID NO: 2822 - protein, 9 aa, Human papillomavirus type 16
TPILPYCNI

SEQ ID NO: 2823 - protein, 9 aa, Human papillomavirus type 16
SAIVLPSTL

SEQ ID NO: 2824 - protein, 9 aa, Human papillomavirus type 16
LGIMSGGHV

SEQ ID NO: 2825 - protein, 10 aa, Human papillomavirus type 16
GGLTGASVSV

SEQ ID NO: 2826 - protein, 10 aa, Human papillomavirus type 16
GLVPNGIYPV

SEQ ID NO: 2827 - protein, 10 aa, Human papillomavirus type 16
LVPNGIYPVR

SEQ ID NO: 2828 - protein, 10 aa, Human papillomavirus type 16
NGIYPVRPPV

SEQ ID NO: 2829 - protein, 10 aa, Human papillomavirus type 16
RPPVPDPVPI

SEQ ID NO: 2830 - protein, 10 aa, Human papillomavirus type 16
IPNPPKNTPI

SEQ ID NO: 2831 - protein, 10 aa, Human papillomavirus type 16
LPYCNICSAI

SEQ ID NO: 2832 - protein, 10 aa, Human papillomavirus type 16
GHVPACLHVL

SEQ ID NO: 2833 - protein, 8 aa, Human papillomavirus type 16
MQYQDLSY

SEQ ID NO: 2834 - protein, 8 aa, Human papillomavirus type 16
SRHCNSFW

SEQ ID NO: 2835 - protein, 8 aa, Human papillomavirus type 16
LRQKLVTL

SEQ ID NO: 2836 - protein, 8 aa, Human papillomavirus type 16
RRHCSIQC

SEQ ID NO: 2837 - protein, 8 aa, Human papillomavirus type 16
IQCTMLFK

SEQ ID NO: 2838 - protein, 9 aa, Human papillomavirus type 16
MLWMQYQDL

SEQ ID NO: 2839 - protein, 9 aa, Human papillomavirus type 16
MQYQDLSYR

SEQ ID NO: 2840 - protein, 9 aa, Human papillomavirus type 16
KSSRHCNSF

SEQ ID NO: 2841 - protein, 9 aa, Human papillomavirus type 16
SRHCNSFWY

SEQ ID NO: 2842 - protein, 9 aa, Human papillomavirus type 16
WYFNLRQKL

SEQ ID NO: 2843 - protein, 9 aa, Human papillomavirus type 16
NLRQKLVTL

SEQ ID NO: 2844 - protein, 9 aa, Human papillomavirus type 16
RQKLVTLPF

SEQ ID NO: 2845 - protein, 9 aa, Human papillomavirus type 16
KLVTLPFTI

SEQ ID NO: 2846 - protein, 9 aa, Human papillomavirus type 16
LPFTIICKC

SEQ ID NO: 2847 - protein, 9 aa, Human papillomavirus type 16
MFYIMSCPM

SEQ ID NO: 2848 - protein, 9 aa, Human papillomavirus type 16
MPCRRHCSI

SEQ ID NO: 2849 - protein, 9 aa, Human papillomavirus type 16
CRRHCSIQC

SEQ ID NO: 2850 - protein, 9 aa, Human papillomavirus type 16
RRHCSIQCT

SEQ ID NO: 2851 - protein, 10 aa, Human papillomavirus type 16
MQYQDLSYRH

SEQ ID NO: 2852 - protein, 10 aa, Human papillomavirus type 16
YRHKSSRHCN

SEQ ID NO: 2853 - protein, 10 aa, Human papillomavirus type 16
KSSRHCNSFW

SEQ ID NO: 2854 - protein, 10 aa, Human papillomavirus type 16
SRHCNSFWYF

SEQ ID NO: 2855 - protein, 10 aa, Human papillomavirus type 16
LRQKLVTLPF

SEQ ID NO: 2856 - protein, 10 aa, Human papillomavirus type 16
CRRHCSIQCT

SEQ ID NO: 2857 - protein, 10 aa, Human papillomavirus type 16
RRHCSIQCTM

SEQ ID NO: 2858 - protein, 9 aa, Human papillomavirus type 16
YGCSVTITV

SEQ ID NO: 2859 - protein, 8 aa, Human papillomavirus type 16
IAYVSIKL

SEQ ID NO: 2860 - protein, 9 aa, Human papillomavirus type 16
CPVCIMHCI

SEQ ID NO: 2861 - protein, 9 aa, Human papillomavirus type 16
CIMHCIAYV

SEQ ID NO: 2862 - protein, 9 aa, Human papillomavirus type 16
AYVSIKLHF

SEQ ID NO: 2863 - protein, 9 aa, Human papillomavirus type 16
MFKSHFSGL

SEQ ID NO: 2864 - protein, 9 aa, Human papillomavirus type 16
EGILVVPMV

SEQ ID NO: 2865 - protein, 9 aa, Human papillomavirus type 16
ILVVPMVYA

SEQ ID NO: 2866 - protein, 9 aa, Human papillomavirus type 16
LVVPMVYAL

SEQ ID NO: 2867 - protein, 8 aa, Human papillomavirus type 16
MHFLNCHL

SEQ ID NO: 2868 - protein, 10 aa, Human papillomavirus type 16
CHLCSSNRAL

SEQ ID NO: 2869 - protein, 9 aa, Human papillomavirus type 16
VIVFLYCQL

SEQ ID NO: 2870 - protein, 9 aa, Human papillomavirus type 16
FLYCQLYWV

SEQ ID NO: 2871 - protein, 10 aa, Human papillomavirus type 16
VVIVFLYCQL

SEQ ID NO: 2872 - protein, 8 aa, Human papillomavirus type 16
QQYTNRNT

SEQ ID NO: 2873 - protein, 8 aa, Human papillomavirus type 16
NRNTLIYY

SEQ ID NO: 2874 - protein, 9 aa, Human papillomavirus type 16
QQYTNRNTL

SEQ ID NO: 2875 - protein, 9 aa, Human papillomavirus type 16
NRNTLIYYF

SEQ ID NO: 2876 - protein, 10 aa, Human papillomavirus type 16
MQQYTNRNTL

SEQ ID NO: 2877 - protein, 10 aa, Human papillomavirus type 16
QQYTNRNTLI

SEQ ID NO: 2878 - protein, 8 aa, Human papillomavirus type 16
FQSHGALL

SEQ ID NO: 2879 - protein, 8 aa, Human papillomavirus type 16
TRCLRFQI

SEQ ID NO: 2880 - protein, 8 aa, Human papillomavirus type 16
LRFQIISF

SEQ ID NO: 2881 - protein, 8 aa, Human papillomavirus type 16
LQLYFVFL

SEQ ID NO: 2882 - protein, 9 aa, Human papillomavirus type 16
VFQSHGALL

SEQ ID NO: 2883 - protein, 9 aa, Human papillomavirus type 16
LQYCHTRCL

SEQ ID NO: 2884 - protein, 9 aa, Human papillomavirus type 16
TRCLRFQII

SEQ ID NO: 2885 - protein, 9 aa, Human papillomavirus type 16
CLRFQIISF

SEQ ID NO: 2886 - protein, 9 aa, Human papillomavirus type 16
LRFQIISFL

SEQ ID NO: 2887 - protein, 9 aa, Human papillomavirus type 16
FQIISFLQL

SEQ ID NO: 2888 - protein, 9 aa, Human papillomavirus type 16
SFLQLYFVF

SEQ ID NO: 2889 - protein, 9 aa, Human papillomavirus type 16
FLQLYFVFL

SEQ ID NO: 2890 - protein, 9 aa, Human papillomavirus type 16
LQLYFVFLY

SEQ ID NO: 2891 - protein, 9 aa, Human papillomavirus type 16
QLYFVFLYI

SEQ ID NO: 2892 - protein, 10 aa, Human papillomavirus type 16
LPVTSAEFPL

SEQ ID NO: 2893 - protein, 10 aa, Human papillomavirus type 16
FPLQYCHTRC

SEQ ID NO: 2894 - protein, 10 aa, Human papillomavirus type 16
LQYCHTRCLR

SEQ ID NO: 2895 - protein, 10 aa, Human papillomavirus type 16
QYCHTRCLRF

SEQ ID NO: 2896 - protein, 10 aa, Human papillomavirus type 16
TRCLRFQIIS

SEQ ID NO: 2897 - protein, 10 aa, Human papillomavirus type 16
LRFQIISFLQ

SEQ ID NO: 2898 - protein, 10 aa, Human papillomavirus type 16
RFQIISFLQL

SEQ ID NO: 2899 - protein, 10 aa, Human papillomavirus type 16
FQIISFLQLY

SEQ ID NO: 2900 - protein, 10 aa, Human papillomavirus type 16
IISFLQLYFV

SEQ ID NO: 2901 - protein, 10 aa, Human papillomavirus type 16
SFLQLYFVFL

SEQ ID NO: 2902 - protein, 10 aa, Human papillomavirus type 16
FLQLYFVFLY

SEQ ID NO: 2903 - protein, 8 aa, Human papillomavirus type 16
VRFCLSSW

SEQ ID NO: 2904 - protein, 9 aa, Human papillomavirus type 16
VRFCLSSWT

SEQ ID NO: 2905 - protein, 10 aa, Human papillomavirus type 16
VRFCLSSWTI

SEQ ID NO: 2906 - protein, 10 aa, Human papillomavirus type 16
CLSSWTIYFI

SEQ ID NO: 2907 - protein, 9 aa, Human papillomavirus type 16
CRCISMHDY

SEQ ID NO: 2908 - protein, 9 aa, Human papillomavirus type 16
MHDYSWVSL

SEQ ID NO: 2909 - protein, 10 aa, Human papillomavirus type 16
CRCISMHDYS

SEQ ID NO: 2910 - protein, 10 aa, Human papillomavirus type 16
SMHDYSWVSL

SEQ ID NO: 2911 - protein, 10 aa, Human papillomavirus type 16
DYSWVSLRVL

SEQ ID NO: 2912 - protein, 8 aa, Human papillomavirus type 16
SRKAKSYT

SEQ ID NO: 2913 - protein, 8 aa, Human papillomavirus type 16
SRRSNCCL

SEQ ID NO: 2914 - protein, 8 aa, Human papillomavirus type 16
LQYTHSNI

SEQ ID NO: 2915 - protein, 9 aa, Human papillomavirus type 16
SRKAKSYTS

SEQ ID NO: 2916 - protein, 9 aa, Human papillomavirus type 16
RRSNCCLQY

SEQ ID NO: 2917 - protein, 9 aa, Human papillomavirus type 16
LQYTHSNII

SEQ ID NO: 2918 - protein, 10 aa, Human papillomavirus type 16
SRKAKSYTSR

SEQ ID NO: 2919 - protein, 10 aa, Human papillomavirus type 16
SRRSNCCLQY

SEQ ID NO: 2920 - protein, 10 aa, Human papillomavirus type 16
RRSNCCLQYT

SEQ ID NO: 2921 - protein, 10 aa, Human papillomavirus type 16
LQYTHSNIIS

SEQ ID NO: 2922 - protein, 10 aa, Artificial Sequence
  Description of Artificial Sequence:  Synthetic Peptide
ELLSSRRKRL

SEQ ID NO: 2923 - protein, 9 aa, Artificial Sequence
  Description of Artificial Sequence:  Synthetic Peptide
SSRRKRLAM

SEQ ID NO: 2924 - protein, 10 aa, Artificial Sequence
  Description of Artificial Sequence:  Synthetic Peptide
LSSRRKRLAM

SEQ ID NO: 2925 - protein, 9 aa, Artificial Sequence
  Description of Artificial Sequence:  Synthetic Peptide
SSRRKRLAM

SEQ ID NO: 2926 - protein, 9 aa, Artificial Sequence
  Description of Artificial Sequence:  Synthetic Peptide
SSRRKRLAM

SEQ ID NO: 2927 - protein, 9 aa, Artificial Sequence
  Description of Artificial Sequence:  Synthetic Peptide
GATLHHESL

SEQ ID NO: 2928 - protein, 9 aa, Artificial Sequence
  Description of Artificial Sequence:  Synthetic Peptide
LLSSRRKRL

SEQ ID NO: 2929 - protein, 10 aa, Artificial Sequence
  Description of Artificial Sequence:  Synthetic Peptide
AASPTSWGTY

SEQ ID NO: 2930 - protein, 10 aa, Artificial Sequence
  Description of Artificial Sequence:  Synthetic Peptide
RSSAPLLEAL

SEQ ID NO: 2931 - protein, 10 aa, Artificial Sequence
  Description of Artificial Sequence:  Synthetic Peptide
GPWRMASGFW

SEQ ID NO: 2932 - protein, 9 aa, Artificial Sequence
  Description of Artificial Sequence:  Synthetic Peptide
GPWRMASGF

SEQ ID NO: 2933 - protein, 9 aa, Artificial Sequence
  Description of Artificial Sequence:  Synthetic Peptide
ASPTSWGTY

SEQ ID NO: 2934 - protein, 9 aa, Artificial Sequence
  Description of Artificial Sequence:  Synthetic Peptide
TPGVGRAIW

SEQ ID NO: 2935 - protein, 10 aa, Artificial Sequence
  Description of Artificial Sequence:  Synthetic Peptide
AAGGRDGSCL

SEQ ID NO: 2936 - protein, 10 aa, Artificial Sequence
  Description of Artificial Sequence:  Synthetic Peptide
AIWVRSSIPL

SEQ ID NO: 2937 - protein, 9 aa, Artificial Sequence
  Description of Artificial Sequence:  Synthetic Peptide
AGGRDGSCL

SEQ ID NO: 2938 - protein, 9 aa, Artificial Sequence
  Description of Artificial Sequence:  Synthetic Peptide
TYRSSAPLL

SEQ ID NO: 2939 - protein, 9 aa, Artificial Sequence
  Description of Artificial Sequence:  Synthetic Peptide
SCLPVALGL

SEQ ID NO: 2940 - protein, 10 aa, Artificial Sequence
  Description of Artificial Sequence:  Synthetic Peptide
AIWVRSSIPL

SEQ ID NO: 2941 - protein, 10 aa, Artificial Sequence
  Description of Artificial Sequence:  Synthetic Peptide
RMASGFWKTA

SEQ ID NO: 2942 - protein, 9 aa, Artificial Sequence
  Description of Artificial Sequence:  Synthetic Peptide
RMASGFWKT

SEQ ID NO: 2943 - protein, 10 aa, Artificial Sequence
  Description of Artificial Sequence:  Synthetic Peptide
LLEALPGPWR

SEQ ID NO: 2944 - protein, 10 aa, Artificial Sequence
  Description of Artificial Sequence:  Synthetic Peptide
ALSLSSFWPC

SEQ ID NO: 2945 - protein, 10 aa, Artificial Sequence
  Description of Artificial Sequence:  Synthetic Peptide
MQQGTFLVAL

SEQ ID NO: 2946 - protein, 10 aa, Artificial Sequence
  Description of Artificial Sequence:  Synthetic Peptide
SLSSFWPCSL

SEQ ID NO: 2947 - protein, 9 aa, Artificial Sequence
  Description of Artificial Sequence:  Synthetic Peptide
QQGTFLVAL

SEQ ID NO: 2948 - protein, 9 aa, Artificial Sequence
  Description of Artificial Sequence:  Synthetic Peptide
SCTLRGASL

SEQ ID NO: 2949 - protein, 10 aa, Artificial Sequence
  Description of Artificial Sequence:  Synthetic Peptide
RSFDVTSICL

SEQ ID NO: 2950 - protein, 10 aa, Artificial Sequence
  Description of Artificial Sequence:  Synthetic Peptide
APPSVRPSTW

SEQ ID NO: 2951 - protein, 10 aa, Artificial Sequence
  Description of Artificial Sequence:  Synthetic Peptide
TGRRKVAIAL

SEQ ID NO: 2952 - protein, 9 aa, Artificial Sequence
  Description of Artificial Sequence:  Synthetic Peptide
SPRRSFDVT

SEQ ID NO: 2953 - protein, 9 aa, Artificial Sequence
  Description of Artificial Sequence:  Synthetic Peptide
SFDVTSICL

SEQ ID NO: 2954 - protein, 10 aa, Artificial Sequence
  Description of Artificial Sequence:  Synthetic Peptide
FLSANCLPSL

SEQ ID NO: 2955 - protein, 10 aa, Artificial Sequence
  Description of Artificial Sequence:  Synthetic Peptide
GLSFLSANCL

SEQ ID NO: 2956 - protein, 9 aa, Artificial Sequence
  Description of Artificial Sequence:  Synthetic Peptide
CLSGAPPSV

SEQ ID NO: 2957 - protein, 10 aa, Artificial Sequence
  Description of Artificial Sequence:  Synthetic Peptide
GFSITTSSTL

SEQ ID NO: 2958 - protein, 10 aa, Artificial Sequence
  Description of Artificial Sequence:  Synthetic Peptide
CPRRVCVVRY

SEQ ID NO: 2959 - protein, 10 aa, Artificial Sequence
  Description of Artificial Sequence:  Synthetic Peptide
RPPTAGVKMI

SEQ ID NO: 2960 - protein, 9 aa, Artificial Sequence
  Description of Artificial Sequence:  Synthetic Peptide
RPPTAGVKM

SEQ ID NO: 2961 - protein, 9 aa, Artificial Sequence
  Description of Artificial Sequence:  Synthetic Peptide
CVVRYIASL

SEQ ID NO: 2962 - protein, 9 aa, Artificial Sequence
  Description of Artificial Sequence:  Synthetic Peptide
RPPTAGVKM

SEQ ID NO: 2963 - protein, 9 aa, Artificial Sequence
  Description of Artificial Sequence:  Synthetic Peptide
TAGTTPQNL

SEQ ID NO: 2964 - protein, 10 aa, Artificial Sequence
  Description of Artificial Sequence:  Synthetic Peptide
SLPAPWWWER

SEQ ID NO: 2965 - protein, 10 aa, Artificial Sequence
  Description of Artificial Sequence:  Synthetic Peptide
RYIASLPAPW

SEQ ID NO: 2966 - protein, 9 aa, Artificial Sequence
  Description of Artificial Sequence:  Synthetic Peptide
KMIRTSSSL

SEQ ID NO: 2967 - protein, 10 aa, Artificial Sequence
  Description of Artificial Sequence:  Synthetic Peptide
VLCPRRVCVV

SEQ ID NO: 2968 - protein, 10 aa, Artificial Sequence
  Description of Artificial Sequence:  Synthetic Peptide
AVCLPRRVCV

SEQ ID NO: 2969 - protein, 10 aa, Artificial Sequence
  Description of Artificial Sequence:  Synthetic Peptide
KMIRTSSSLT

SEQ ID NO: 2970 - protein, 10 aa, Artificial Sequence
  Description of Artificial Sequence:  Synthetic Peptide
NLAVLCPRRV

SEQ ID NO: 2971 - protein, 9 aa, Artificial Sequence
  Description of Artificial Sequence:  Synthetic Peptide
VLCPRRVCV

SEQ ID NO: 2972 - protein, 9 aa, Artificial Sequence
  Description of Artificial Sequence:  Synthetic Peptide
KMIRTSSSL

SEQ ID NO: 2973 - protein, 9 aa, Artificial Sequence
  Description of Artificial Sequence:  Synthetic Peptide
TIPGHRWAI

SEQ ID NO: 2974 - protein, 9 aa, Artificial Sequence
  Description of Artificial Sequence:  Synthetic Peptide
VLPSSCSSA

SEQ ID NO: 2975 - protein, 10 aa, Artificial Sequence
  Description of Artificial Sequence:  Synthetic Peptide
LYPSSCSSAL

SEQ ID NO: 2976 - protein, 9 aa, Artificial Sequence
  Description of Artificial Sequence:  Synthetic Peptide
HPWPGRTVL

SEQ ID NO: 2977 - protein, 9 aa, Artificial Sequence
  Description of Artificial Sequence:  Synthetic Peptide
YPSSCSSAL

SEQ ID NO: 2978 - protein, 9 aa, Artificial Sequence
  Description of Artificial Sequence:  Synthetic Peptide
TACEIWPWL

SEQ ID NO: 2979 - protein, 9 aa, Artificial Sequence
  Description of Artificial Sequence:  Synthetic Peptide
MFITISLLF

SEQ ID NO: 2980 - protein, 9 aa, Artificial Sequence
  Description of Artificial Sequence:  Synthetic Peptide
TACEIWPWL

SEQ ID NO: 2981 - protein, 10 aa, Artificial Sequence
  Description of Artificial Sequence:  Synthetic Peptide
FITISLLFGT

SEQ ID NO: 2982 - protein, 10 aa, Artificial Sequence
  Description of Artificial Sequence:  Synthetic Peptide
LLFGTGRTTA

SEQ ID NO: 2983 - protein, 10 aa, Artificial Sequence
  Description of Artificial Sequence:  Synthetic Peptide
MEWSPRVGGC

SEQ ID NO: 2984 - protein, 10 aa, Artificial Sequence
  Description of Artificial Sequence:  Synthetic Peptide
RGPSRHPRVL

SEQ ID NO: 2985 - protein, 9 aa, Artificial Sequence
  Description of Artificial Sequence:  Synthetic Peptide
GLSTTGPER

SEQ ID NO: 2986 - protein, 9 aa, Artificial Sequence
  Description of Artificial Sequence:  Synthetic Peptide
GPSRHPRVL

SEQ ID NO: 2987 - protein, 9 aa, Artificial Sequence
  Description of Artificial Sequence:  Synthetic Peptide
HPRVLSSCR

SEQ ID NO: 2988 - protein, 10 aa, Artificial Sequence
  Description of Artificial Sequence:  Synthetic Peptide
HPRVLSSCRI

SEQ ID NO: 2989 - protein, 9 aa, Artificial Sequence
  Description of Artificial Sequence:  Synthetic Peptide
GPSRHPRVL

SEQ ID NO: 2990 - protein, 10 aa, Artificial Sequence
  Description of Artificial Sequence:  Synthetic Peptide
HPRVLSSRCI

SEQ ID NO: 2991 - protein, 10 aa, Artificial Sequence
  Description of Artificial Sequence:  Synthetic Peptide
APRSRLHMQL

SEQ ID NO: 2992 - protein, 9 aa, Artificial Sequence
  Description of Artificial Sequence:  Synthetic Peptide
KAPRSRLHM

SEQ ID NO: 2993 - protein, 10 aa, Artificial Sequence
  Description of Artificial Sequence:  Synthetic Peptide
APRSRLHMQL

SEQ ID NO: 2994 - protein, 9 aa, Artificial Sequence
  Description of Artificial Sequence:  Synthetic Peptide
AAKAPRSRL

SEQ ID NO: 2995 - protein, 10 aa, Artificial Sequence
  Description of Artificial Sequence:  Synthetic Peptide
APRSRLHMQL

SEQ ID NO: 2996 - protein, 10 aa, Artificial Sequence
  Description of Artificial Sequence:  Synthetic Peptide
AAAKAPRSRL

SEQ ID NO: 2997 - protein, 9 aa, Artificial Sequence
  Description of Artificial Sequence:  Synthetic Peptide
AAKAPRSRL

SEQ ID NO: 2998 - protein, 10 aa, Artificial Sequence
  Description of Artificial Sequence:  Synthetic Peptide
MPHPSWASAL

SEQ ID NO: 2999 - protein, 10 aa, Artificial Sequence
  Description of Artificial Sequence:  Synthetic Peptide
CPIPTSRRLL

SEQ ID NO: 3000 - protein, 10 aa, Artificial Sequence
  Description of Artificial Sequence:  Synthetic Peptide
HPSWASALSL

SEQ ID NO: 3001 - protein, 9 aa, Artificial Sequence
  Description of Artificial Sequence:  Synthetic Peptide
CPPPERSLF

SEQ ID NO: 3002 - protein, 9 aa, Artificial Sequence
  Description of Artificial Sequence:  Synthetic Peptide
CPIPTSRRL

SEQ ID NO: 3003 - protein, 10 aa, Artificial Sequence
  Description of Artificial Sequence:  Synthetic Peptide
CPIPTSRRLL

SEQ ID NO: 3004 - protein, 10 aa, Artificial Sequence
  Description of Artificial Sequence:  Synthetic Peptide
MPHPSWASAL

SEQ ID NO: 3005 - protein, 10 aa, Artificial Sequence
  Description of Artificial Sequence:  Synthetic Peptide
HPSWASALSL

SEQ ID NO: 3006 - protein, 10 aa, Artificial Sequence
  Description of Artificial Sequence:  Synthetic Peptide
KQRLRGRDWL

SEQ ID NO: 3007 - protein, 10 aa, Artificial Sequence
  Description of Artificial Sequence:  Synthetic Peptide
SALSLTKQRL

SEQ ID NO: 3008 - protein, 9 aa, Artificial Sequence
  Description of Artificial Sequence:  Synthetic Peptide
CPIPTSRRL

SEQ ID NO: 3009 - protein, 9 aa, Artificial Sequence
  Description of Artificial Sequence:  Synthetic Peptide
ALSLTKQRL

SEQ ID NO: 3010 - protein, 9 aa, Artificial Sequence
  Description of Artificial Sequence:  Synthetic Peptide
WLCSPPPPL

SEQ ID NO: 3011 - protein, 9 aa, Artificial Sequence
  Description of Artificial Sequence:  Synthetic Peptide
ALSLTKQRL

SEQ ID NO: 3012 - protein, 10 aa, Artificial Sequence
  Description of Artificial Sequence:  Synthetic Peptide
CPSSRPAAML

SEQ ID NO: 3013 - protein, 9 aa, Artificial Sequence
  Description of Artificial Sequence:  Synthetic Peptide
CPSSRPAAM

SEQ ID NO: 3014 - protein, 9 aa, Artificial Sequence
  Description of Artificial Sequence:  Synthetic Peptide
MPWPTTAVL

SEQ ID NO: 3015 - protein, 9 aa, Artificial Sequence
  Description of Artificial Sequence:  Synthetic Peptide
RPAAMLSSW

SEQ ID NO: 3016 - protein, 10 aa, Artificial Sequence
  Description of Artificial Sequence:  Synthetic Peptide
CPSSRPAAML

SEQ ID NO: 3017 - protein, 10 aa, Artificial Sequence
  Description of Artificial Sequence:  Synthetic Peptide
AAMLSSWQPM

SEQ ID NO: 3018 - protein, 9 aa, Artificial Sequence
  Description of Artificial Sequence:  Synthetic Peptide
MPWPTTAVL

SEQ ID NO: 3019 - protein, 9 aa, Artificial Sequence
  Description of Artificial Sequence:  Synthetic Peptide
CPSSRPAAM

SEQ ID NO: 3020 - protein, 9 aa, Artificial Sequence
  Description of Artificial Sequence:  Synthetic Peptide
AMLSSWQPM

SEQ ID NO: 3021 - protein, 9 aa, Artificial Sequence
  Description of Artificial Sequence:  Synthetic Peptide
RPPRLQLGY

SEQ ID NO: 3022 - protein, 9 aa, Artificial Sequence
  Description of Artificial Sequence:  Synthetic Peptide
SSRPPRLQL

SEQ ID NO: 3023 - protein, 10 aa, Artificial Sequence
  Description of Artificial Sequence:  Synthetic Peptide
SPALNVGAGL

SEQ ID NO: 3024 - protein, 10 aa, Artificial Sequence
  Description of Artificial Sequence:  Synthetic Peptide
SVSAMTQAVL

SEQ ID NO: 3025 - protein, 10 aa, Artificial Sequence
  Description of Artificial Sequence:  Synthetic Peptide
AGGSQASTDL

SEQ ID NO: 3026 - protein, 10 aa, Artificial Sequence
  Description of Artificial Sequence:  Synthetic Peptide
LGMSSRPPRL

SEQ ID NO: 3027 - protein, 10 aa, Artificial Sequence
  Description of Artificial Sequence:  Synthetic Peptide
STRPSSVSAM

SEQ ID NO: 3028 - protein, 9 aa, Artificial Sequence
  Description of Artificial Sequence:  Synthetic Peptide
SSRPPRLQL

SEQ ID NO: 3029 - protein, 9 aa, Artificial Sequence
  Description of Artificial Sequence:  Synthetic Peptide
GMSSRPPRL

SEQ ID NO: 3030 - protein, 10 aa, Artificial Sequence
  Description of Artificial Sequence:  Synthetic Peptide
RQSRVGRTFL

SEQ ID NO: 3031 - protein, 9 aa, Artificial Sequence
  Description of Artificial Sequence:  Synthetic Peptide
QSRVGRTFL

SEQ ID NO: 3032 - protein, 10 aa, Artificial Sequence
  Description of Artificial Sequence:  Synthetic Peptide
YPRQSRVGRT

SEQ ID NO: 3033 - protein, 10 aa, Artificial Sequence
  Description of Artificial Sequence:  Synthetic Peptide
YPRQSRVGRT

SEQ ID NO: 3034 - protein, 9 aa, Artificial Sequence
  Description of Artificial Sequence:  Synthetic Peptide
QSRVGRTFL

SEQ ID NO: 3035 - protein, 10 aa, Artificial Sequence
  Description of Artificial Sequence:  Synthetic Peptide
SPALNVGAGL

SEQ ID NO: 3036 - protein, 10 aa, Artificial Sequence
  Description of Artificial Sequence:  Synthetic Peptide
YTDWALFRMK

SEQ ID NO: 3037 - protein, 10 aa, Artificial Sequence
  Description of Artificial Sequence:  Synthetic Peptide
CYTDWALFRM

SEQ ID NO: 3038 - protein, 9 aa, Artificial Sequence
  Description of Artificial Sequence:  Synthetic Peptide
HPCYTDWAL

SEQ ID NO: 3039 - protein, 9 aa, Artificial Sequence
  Description of Artificial Sequence:  Synthetic Peptide
HPCYTDWAL

SEQ ID NO: 3040 - protein, 10 aa, Artificial Sequence
  Description of Artificial Sequence:  Synthetic Peptide
HPCYTDWALF

SEQ ID NO: 3041 - protein, 10 aa, Artificial Sequence
  Description of Artificial Sequence:  Synthetic Peptide
ALSTYRTSSK

SEQ ID NO: 3042 - protein, 9 aa, Artificial Sequence
  Description of Artificial Sequence:  Synthetic Peptide
MARAWRELL

SEQ ID NO: 3043 - protein, 9 aa, Artificial Sequence
  Description of Artificial Sequence:  Synthetic Peptide
MARAWRELL

SEQ ID NO: 3044 - protein, 10 aa, Artificial Sequence
  Description of Artificial Sequence:  Synthetic Peptide
PPRTTCRRAM

SEQ ID NO: 3045 - protein, 10 aa, Artificial Sequence
  Description of Artificial Sequence:  Synthetic Peptide
PPRTTCRRAM

SEQ ID NO: 3046 - protein, 10 aa, Artificial Sequence
  Description of Artificial Sequence:  Synthetic Peptide
ASLPYSAASL

SEQ ID NO: 3047 - protein, 9 aa, Artificial Sequence
  Description of Artificial Sequence:  Synthetic Peptide
RAMQLPASL

SEQ ID NO: 3048 - protein, 9 aa, Artificial Sequence
  Description of Artificial Sequence:  Synthetic Peptide
RAMQLPASL

SEQ ID NO: 3049 - protein, 9 aa, Artificial Sequence
  Description of Artificial Sequence:  Synthetic Peptide
SLPYSAASL

SEQ ID NO: 3050 - protein, 9 aa, Artificial Sequence
  Description of Artificial Sequence:  Synthetic Peptide
RYGGCLQRN

SEQ ID NO: 3051 - protein, 10 aa, Artificial Sequence
  Description of Artificial Sequence:  Synthetic Peptide
RYGGCLQRNT

SEQ ID NO: 3052 - protein, 10 aa, Artificial Sequence
  Description of Artificial Sequence:  Synthetic Peptide
TPRAPVPPFL

SEQ ID NO: 3053 - protein, 9 aa, Artificial Sequence
  Description of Artificial Sequence:  Synthetic Peptide
TPRAPVPPF

SEQ ID NO: 3054 - protein, 10 aa, Artificial Sequence
  Description of Artificial Sequence:  Synthetic Peptide
TPRAPVPPFL

SEQ ID NO: 3055 - protein, 10 aa, Artificial Sequence
  Description of Artificial Sequence:  Synthetic Peptide
TTRSRYGGCL

SEQ ID NO: 3056 - protein, 10 aa, Artificial Sequence
  Description of Artificial Sequence:  Synthetic Peptide
TPRAPVPPFL

SEQ ID NO: 3057 - protein, 9 aa, Artificial Sequence
  Description of Artificial Sequence:  Synthetic Peptide
WPSSPPEAL

SEQ ID NO: 3058 - protein, 9 aa, Artificial Sequence
  Description of Artificial Sequence:  Synthetic Peptide
SPIPPCPPW

SEQ ID NO: 3059 - protein, 10 aa, Artificial Sequence
  Description of Artificial Sequence:  Synthetic Peptide
RSVVRPTRRM

SEQ ID NO: 3060 - protein, 10 aa, Artificial Sequence
  Description of Artificial Sequence:  Synthetic Peptide
LGRSGRWSSL

SEQ ID NO: 3061 - protein, 10 aa, Artificial Sequence
  Description of Artificial Sequence:  Synthetic Peptide
AARFHLQSPL

SEQ ID NO: 3062 - protein, 10 aa, Artificial Sequence
  Description of Artificial Sequence:  Synthetic Peptide
AARFHLQSPL

SEQ ID NO: 3063 - protein, 10 aa, Artificial Sequence
  Description of Artificial Sequence:  Synthetic Peptide
LGRSGRWSSL

SEQ ID NO: 3064 - protein, 10 aa, Artificial Sequence
  Description of Artificial Sequence:  Synthetic Peptide
APPTPTLSPI

SEQ ID NO: 3065 - protein, 10 aa, Artificial Sequence
  Description of Artificial Sequence:  Synthetic Peptide
APRKNRNCPS

SEQ ID NO: 3066 - protein, 10 aa, Artificial Sequence
  Description of Artificial Sequence:  Synthetic Peptide
ALAAPQLPAL

SEQ ID NO: 3067 - protein, 10 aa, Artificial Sequence
  Description of Artificial Sequence:  Synthetic Peptide
PPCPPWRGSL

SEQ ID NO: 3068 - protein, 9 aa, Artificial Sequence
  Description of Artificial Sequence:  Synthetic Peptide
WPSSPPEAL

SEQ ID NO: 3069 - protein, 9 aa, Artificial Sequence
  Description of Artificial Sequence:  Synthetic Peptide
LAAPPTPTL

SEQ ID NO: 3070 - protein, 9 aa, Artificial Sequence
  Description of Artificial Sequence:  Synthetic Peptide
LAAPQLPAL

SEQ ID NO: 3071 - protein, 9 aa, Artificial Sequence
  Description of Artificial Sequence:  Synthetic Peptide
RATIRQHPL

SEQ ID NO: 3072 - protein, 9 aa, Artificial Sequence
  Description of Artificial Sequence:  Synthetic Peptide
RFHLQSPLL

SEQ ID NO: 3073 - protein, 9 aa, Artificial Sequence
  Description of Artificial Sequence:  Synthetic Peptide
RQHPLSPPL

SEQ ID NO: 3074 - protein, 9 aa, Artificial Sequence
  Description of Artificial Sequence:  Synthetic Peptide
SLGIRILAT

SEQ ID NO: 3075 - protein, 9 aa, Artificial Sequence
  Description of Artificial Sequence:  Synthetic Peptide
RMSCAAQCL

SEQ ID NO: 3076 - protein, 9 aa, Artificial Sequence
  Description of Artificial Sequence:  Synthetic Peptide
LLAAPPTPT

SEQ ID NO: 3077 - protein, 9 aa, Artificial Sequence
  Description of Artificial Sequence:  Synthetic Peptide
QLPALRATI

SEQ ID NO: 3078 - protein, 10 aa, Artificial Sequence
  Description of Artificial Sequence:  Synthetic Peptide
ALAAPQLPAL

SEQ ID NO: 3079 - protein, 10 aa, Artificial Sequence
  Description of Artificial Sequence:  Synthetic Peptide
LLAAPPTPTL

SEQ ID NO: 3080 - protein, 10 aa, Artificial Sequence
  Description of Artificial Sequence:  Synthetic Peptide
WPSSPSPRGF

SEQ ID NO: 3081 - protein, 10 aa, Artificial Sequence
  Description of Artificial Sequence:  Synthetic Peptide
IPAALTPQSL

SEQ ID NO: 3082 - protein, 10 aa, Artificial Sequence
  Description of Artificial Sequence:  Synthetic Peptide
SPRGFMLGAL

SEQ ID NO: 3083 - protein, 9 aa, Artificial Sequence
  Description of Artificial Sequence:  Synthetic Peptide
SPSPRGFML

SEQ ID NO: 3084 - protein, 9 aa, Artificial Sequence
  Description of Artificial Sequence:  Synthetic Peptide
SSPSPRGFM

SEQ ID NO: 3085 - protein, 10 aa, Artificial Sequence
  Description of Artificial Sequence:  Synthetic Peptide
SPRGFMLGAL

SEQ ID NO: 3086 - protein, 9 aa, Artificial Sequence
  Description of Artificial Sequence:  Synthetic Peptide
SPSPRGFML

SEQ ID NO: 3087 - protein, 10 aa, Artificial Sequence
  Description of Artificial Sequence:  Synthetic Peptide
SPRGFMLGAL

SEQ ID NO: 3088 - protein, 10 aa, Artificial Sequence
  Description of Artificial Sequence:  Synthetic Peptide
IPAALTPQSL

SEQ ID NO: 3089 - protein, 10 aa, Artificial Sequence
  Description of Artificial Sequence:  Synthetic Peptide
SVRRRQSTNV

SEQ ID NO: 3090 - protein, 9 aa, Artificial Sequence
  Description of Artificial Sequence:  Synthetic Peptide
SPSPRGFML

SEQ ID NO: 3091 - protein, 9 aa, Artificial Sequence
  Description of Artificial Sequence:  Synthetic Peptide
SPRGFMLGA

SEQ ID NO: 3092 - protein, 9 aa, Artificial Sequence
  Description of Artificial Sequence:  Synthetic Peptide
FMLGALLPI

SEQ ID NO: 3093 - protein, 9 aa, Artificial Sequence
  Description of Artificial Sequence:  Synthetic Peptide
EEAGLPYVA

SEQ ID NO: 3094 - protein, 10 aa, Artificial Sequence
  Description of Artificial Sequence:  Synthetic Peptide
EEAGLPYVAS

SEQ ID NO: 3095 - protein, 10 aa, Artificial Sequence
  Description of Artificial Sequence:  Synthetic Peptide
CELGDTGPGA

SEQ ID NO: 3096 - protein, 10 aa, Artificial Sequence
  Description of Artificial Sequence:  Synthetic Peptide
GPGASALGFW

SEQ ID NO: 3097 - protein, 10 aa, Artificial Sequence
  Description of Artificial Sequence:  Synthetic Peptide
WPHASENLGY

SEQ ID NO: 3098 - protein, 10 aa, Artificial Sequence
  Description of Artificial Sequence:  Synthetic Peptide
SAHFHSTVTL

SEQ ID NO: 3099 - protein, 9 aa, Artificial Sequence
  Description of Artificial Sequence:  Synthetic Peptide
GFWPEEAGL

SEQ ID NO: 3100 - protein, 9 aa, Artificial Sequence
  Description of Artificial Sequence:  Synthetic Peptide
NLGYRPCEL

SEQ ID NO: 3101 - protein, 9 aa, Artificial Sequence
  Description of Artificial Sequence:  Synthetic Peptide
WPEEAGLPY

SEQ ID NO: 3102 - protein, 9 aa, Artificial Sequence
  Description of Artificial Sequence:  Synthetic Peptide
GPAGSGFAY

SEQ ID NO: 3103 - protein, 9 aa, Artificial Sequence
  Description of Artificial Sequence:  Synthetic Peptide
MPGPAGSGF

SEQ ID NO: 3104 - protein, 9 aa, Artificial Sequence
  Description of Artificial Sequence:  Synthetic Peptide
GPAGSGFAY

SEQ ID NO: 3105 - protein, 10 aa, Artificial Sequence
  Description of Artificial Sequence:  Synthetic Peptide
AGSGFAYSCL

SEQ ID NO: 3106 - protein, 10 aa, Artificial Sequence
  Description of Artificial Sequence:  Synthetic Peptide
GEGPGSAAAI

SEQ ID NO: 3107 - protein, 10 aa, Artificial Sequence
  Description of Artificial Sequence:  Synthetic Peptide
GELGEGPGSA

SEQ ID NO: 3108 - protein, 9 aa, Artificial Sequence
  Description of Artificial Sequence:  Synthetic Peptide
GELGEGPGS

SEQ ID NO: 3109 - protein, 9 aa, Artificial Sequence
  Description of Artificial Sequence:  Synthetic Peptide
DELVPYDGV

SEQ ID NO: 3110 - protein, 9 aa, Artificial Sequence
  Description of Artificial Sequence:  Synthetic Peptide
SPGGHSVFL

SEQ ID NO: 3111 - protein, 10 aa, Artificial Sequence
  Description of Artificial Sequence:  Synthetic Peptide
SAAPDPTSHL

SEQ ID NO: 3112 - protein, 9 aa, Artificial Sequence
  Description of Artificial Sequence:  Synthetic Peptide
SPGGHSVFL

SEQ ID NO: 3113 - protein, 9 aa, Artificial Sequence
  Description of Artificial Sequence:  Synthetic Peptide
AAPDPTSHL

SEQ ID NO: 3114 - protein, 9 aa, Artificial Sequence
  Description of Artificial Sequence:  Synthetic Peptide
SVFLHGGEL

SEQ ID NO: 3115 - protein, 10 aa, Artificial Sequence
  Description of Artificial Sequence:  Synthetic Peptide
SLGSPGGHSV

SEQ ID NO: 3116 - protein, 9 aa, Artificial Sequence
  Description of Artificial Sequence:  Synthetic Peptide
GARWRRPGC

SEQ ID NO: 3117 - protein, 10 aa, Artificial Sequence
  Description of Artificial Sequence:  Synthetic Peptide
FGRVLPVNRL

SEQ ID NO: 3118 - protein, 9 aa, Artificial Sequence
  Description of Artificial Sequence:  Synthetic Peptide
PRGCFGRVL

SEQ ID NO: 3119 - protein, 9 aa, Artificial Sequence
  Description of Artificial Sequence:  Synthetic Peptide
RPGGRHEHL

SEQ ID NO: 3120 - protein, 10 aa, Artificial Sequence
  Description of Artificial Sequence:  Synthetic Peptide
LAKGHLGLDM

SEQ ID NO: 3121 - protein, 10 aa, Artificial Sequence
  Description of Artificial Sequence:  Synthetic Peptide
MLRFLAKGHL

SEQ ID NO: 3122 - protein, 9 aa, Artificial Sequence
  Description of Artificial Sequence:  Synthetic Peptide
GLDMRGVER

SEQ ID NO: 3123 - protein, 10 aa, Artificial Sequence
  Description of Artificial Sequence:  Synthetic Peptide
RFLAKGHLGL

SEQ ID NO: 3124 - protein, 9 aa, Artificial Sequence
  Description of Artificial Sequence:  Synthetic Peptide
FLAKGHLGL

SEQ ID NO: 3125 - protein, 9 aa, Artificial Sequence
  Description of Artificial Sequence:  Synthetic Peptide
GLDMRGVER

SEQ ID NO: 3126 - protein, 9 aa, Artificial Sequence
  Description of Artificial Sequence:  Synthetic Peptide
RPGCFGRVL

SEQ ID NO: 3127 - protein, 9 aa, Artificial Sequence
  Description of Artificial Sequence:  Synthetic Peptide
RPGGRHEHL

SEQ ID NO: 3128 - protein, 9 aa, Artificial Sequence
  Description of Artificial Sequence:  Synthetic Peptide
GGLPLRDGY

SEQ ID NO: 3129 - protein, 9 aa, Artificial Sequence
  Description of Artificial Sequence:  Synthetic Peptide
LPLRDGYDY

SEQ ID NO: 3130 - protein, 10 aa, Artificial Sequence
  Description of Artificial Sequence:  Synthetic Peptide
VCRGIRGDKA

SEQ ID NO: 3131 - protein, 10 aa, Artificial Sequence
  Description of Artificial Sequence:  Synthetic Peptide
GLPLRDGYDY

SEQ ID NO: 3132 - protein, 9 aa, Artificial Sequence
  Description of Artificial Sequence:  Synthetic Peptide
VPGPIARIF

SEQ ID NO: 3133 - protein, 10 aa, Artificial Sequence
  Description of Artificial Sequence:  Synthetic Peptide
MPVPGPIARI

SEQ ID NO: 3134 - protein, 10 aa, Artificial Sequence
  Description of Artificial Sequence:  Synthetic Peptide
RPRRRWKEGL

SEQ ID NO: 3135 - protein, 10 aa, Artificial Sequence
  Description of Artificial Sequence:  Synthetic Peptide
RPRRRWKEGL

SEQ ID NO: 3136 - protein, 10 aa, Artificial Sequence
  Description of Artificial Sequence:  Synthetic Peptide
MPQKTWGTAL

SEQ ID NO: 3137 - protein, 10 aa, Artificial Sequence
  Description of Artificial Sequence:  Synthetic Peptide
MPQKTWGTAL

SEQ ID NO: 3138 - protein, 10 aa, Artificial Sequence
  Description of Artificial Sequence:  Synthetic Peptide
KTWGTALASL

SEQ ID NO: 3139 - protein, 9 aa, Artificial Sequence
  Description of Artificial Sequence:  Synthetic Peptide
SLETPGPER

SEQ ID NO: 3140 - protein, 10 aa, Artificial Sequence
  Description of Artificial Sequence:  Synthetic Peptide
GLVRLVHGWL

SEQ ID NO: 3141 - protein, 9 aa, Artificial Sequence
  Description of Artificial Sequence:  Synthetic Peptide
RWPAGLVRL

SEQ ID NO: 3142 - protein, 9 aa, Artificial Sequence
  Description of Artificial Sequence:  Synthetic Peptide
HLPPPQPVK

SEQ ID NO: 3143 - protein, 9 aa, Artificial Sequence
  Description of Artificial Sequence:  Synthetic Peptide
RLVHGWLQR

SEQ ID NO: 3144 - protein, 9 aa, Artificial Sequence
  Description of Artificial Sequence:  Synthetic Peptide
LVRLVHGWL

SEQ ID NO: 3145 - protein, 9 aa, Artificial Sequence
  Description of Artificial Sequence:  Synthetic Peptide
CPAPLDLVL

SEQ ID NO: 3146 - protein, 10 aa, Artificial Sequence
  Description of Artificial Sequence:  Synthetic Peptide
TPACCRGRHL

SEQ ID NO: 3147 - protein, 10 aa, Artificial Sequence
  Description of Artificial Sequence:  Synthetic Peptide
SQRVSCPAPL

SEQ ID NO: 3148 - protein, 10 aa, Artificial Sequence
  Description of Artificial Sequence:  Synthetic Peptide
RVSCPAPLDL

SEQ ID NO: 3149 - protein, 10 aa, Artificial Sequence
  Description of Artificial Sequence:  Synthetic Peptide
TPACCRGRHL

SEQ ID NO: 3150 - protein, 9 aa, Artificial Sequence
  Description of Artificial Sequence:  Synthetic Peptide
CPAPLDLVL

SEQ ID NO: 3151 - protein, 10 aa, Artificial Sequence
  Description of Artificial Sequence:  Synthetic Peptide
TPACCRGRHL

SEQ ID NO: 3152 - protein, 10 aa, Artificial Sequence
  Description of Artificial Sequence:  Synthetic Peptide
VVQQPPGPPL

SEQ ID NO: 3153 - protein, 10 aa, Artificial Sequence
  Description of Artificial Sequence:  Synthetic Peptide
SVVQPPGPPL

SEQ ID NO: 3154 - protein, 9 aa, Artificial Sequence
  Description of Artificial Sequence:  Synthetic Peptide
TYVGAPRPI

SEQ ID NO: 3155 - protein, 9 aa, Artificial Sequence
  Description of Artificial Sequence:  Synthetic Peptide
YVGAPRPIL

SEQ ID NO: 3156 - protein, 9 aa, Artificial Sequence
  Description of Artificial Sequence:  Synthetic Peptide
RACRGAQTY

SEQ ID NO: 3157 - protein, 10 aa, Artificial Sequence
  Description of Artificial Sequence:  Synthetic Peptide
TYVGAPRPIL

SEQ ID NO: 3158 - protein, 10 aa, Artificial Sequence
  Description of Artificial Sequence:  Synthetic Peptide
AARACRGAQT

SEQ ID NO: 3159 - protein, 9 aa, Artificial Sequence
  Description of Artificial Sequence:  Synthetic Peptide
GAVASGAGL

SEQ ID NO: 3160 - protein, 9 aa, Artificial Sequence
  Description of Artificial Sequence:  Synthetic Peptide
LPPRPRHTL

SEQ ID NO: 3161 - protein, 9 aa, Artificial Sequence
  Description of Artificial Sequence:  Synthetic Peptide
RPRHTLQGC

SEQ ID NO: 3162 - protein, 9 aa, Artificial Sequence
  Description of Artificial Sequence:  Synthetic Peptide
LPPRPRHTL

SEQ ID NO: 3163 - protein, 9 aa, Artificial Sequence
  Description of Artificial Sequence:  Synthetic Peptide
RPRHTLQGC

SEQ ID NO: 3164 - protein, 10 aa, Artificial Sequence
  Description of Artificial Sequence:  Synthetic Peptide
RPRHTLQGCL

SEQ ID NO: 3165 - protein, 10 aa, Artificial Sequence
  Description of Artificial Sequence:  Synthetic Peptide
RPRHTLQGCL

SEQ ID NO: 3166 - protein, 10 aa, Artificial Sequence
  Description of Artificial Sequence:  Synthetic Peptide
QELPPRPRHT

SEQ ID NO: 3167 - protein, 9 aa, Artificial Sequence
  Description of Artificial Sequence:  Synthetic Peptide
ALTSPPSIV

SEQ ID NO: 3168 - protein, 9 aa, Artificial Sequence
  Description of Artificial Sequence:  Synthetic Peptide
KQWRGYQAA

SEQ ID NO: 3169 - protein, 10 aa, Artificial Sequence
  Description of Artificial Sequence:  Synthetic Peptide
KQWRGYQAAL

SEQ ID NO: 3170 - protein, 10 aa, Artificial Sequence
  Description of Artificial Sequence:  Synthetic Peptide
LLCHKRPPST

SEQ ID NO: 3171 - protein, 10 aa, Artificial Sequence
  Description of Artificial Sequence:  Synthetic Peptide
HPWSGTRHKL

SEQ ID NO: 3172 - protein, 10 aa, Artificial Sequence
  Description of Artificial Sequence:  Synthetic Peptide
HPWSGTRHKL

SEQ ID NO: 3173 - protein, 9 aa, Artificial Sequence
  Description of Artificial Sequence:  Synthetic Peptide
GPWCFCRCL

SEQ ID NO: 3174 - protein, 9 aa, Artificial Sequence
  Description of Artificial Sequence:  Synthetic Peptide
EPPGSSGAL

SEQ ID NO: 3175 - protein, 9 aa, Artificial Sequence
  Description of Artificial Sequence:  Synthetic Peptide
GPWCFCRCL

SEQ ID NO: 3176 - protein, 9 aa, Artificial Sequence
  Description of Artificial Sequence:  Synthetic Peptide
EPPGSSGAL

SEQ ID NO: 3177 - protein, 10 aa, Artificial Sequence
  Description of Artificial Sequence:  Synthetic Peptide
EPPGSSGALL

SEQ ID NO: 3178 - protein, 10 aa, Artificial Sequence
  Description of Artificial Sequence:  Synthetic Peptide
EPPGSSGALL

SEQ ID NO: 3179 - protein, 10 aa, Artificial Sequence
  Description of Artificial Sequence:  Synthetic Peptide
GPWCFCRCLW

SEQ ID NO: 3180 - protein, 10 aa, Artificial Sequence
  Description of Artificial Sequence:  Synthetic Peptide
SGALLVERSY

SEQ ID NO: 3181 - protein, 9 aa, Artificial Sequence
  Description of Artificial Sequence:  Synthetic Peptide
QGLDLHWYT

SEQ ID NO: 3182 - protein, 9 aa, Artificial Sequence
  Description of Artificial Sequence:  Synthetic Peptide
AERASPQGL

SEQ ID NO: 3183 - protein, 9 aa, Artificial Sequence
  Description of Artificial Sequence:  Synthetic Peptide
RASPQGLDL

SEQ ID NO: 3184 - protein, 9 aa, Artificial Sequence
  Description of Artificial Sequence:  Synthetic Peptide
SPQGLDLHW

SEQ ID NO: 3185 - protein, 10 aa, Artificial Sequence
  Description of Artificial Sequence:  Synthetic Peptide
SPQGLDLHWY

SEQ ID NO: 3186 - protein, 10 aa, Artificial Sequence
  Description of Artificial Sequence:  Synthetic Peptide
SPQGLDLHWY

SEQ ID NO: 3187 - protein, 9 aa, Artificial Sequence
  Description of Artificial Sequence:  Synthetic Peptide
VTELAPSTR

SEQ ID NO: 3188 - protein, 9 aa, Artificial Sequence
  Description of Artificial Sequence:  Synthetic Peptide
APTYPSDTM

SEQ ID NO: 3189 - protein, 9 aa, Artificial Sequence
  Description of Artificial Sequence:  Synthetic Peptide
TSRRRCRPL

SEQ ID NO: 3190 - protein, 9 aa, Artificial Sequence
  Description of Artificial Sequence:  Synthetic Peptide
TSRRRCRPL

SEQ ID NO: 3191 - protein, 9 aa, Artificial Sequence
  Description of Artificial Sequence:  Synthetic Peptide
APTYPSDTM

SEQ ID NO: 3192 - protein, 9 aa, Artificial Sequence
  Description of Artificial Sequence:  Synthetic Peptide
TSRRRCRPL

SEQ ID NO: 3193 - protein, 10 aa, Artificial Sequence
  Description of Artificial Sequence:  Synthetic Peptide
VTELAPSTRR

SEQ ID NO: 3194 - protein, 10 aa, Artificial Sequence
  Description of Artificial Sequence:  Synthetic Peptide
ATSRRRCRPL

SEQ ID NO: 3195 - protein, 10 aa, Artificial Sequence
  Description of Artificial Sequence:  Synthetic Peptide
RCRPLRAPTY

SEQ ID NO: 3196 - protein, 10 aa, Artificial Sequence
  Description of Artificial Sequence:  Synthetic Peptide
RAPTYPSDTM

SEQ ID NO: 3197 - protein, 9 aa, Artificial Sequence
  Description of Artificial Sequence:  Synthetic Peptide
SAGCCCPPL

SEQ ID NO: 3198 - protein, 10 aa, Artificial Sequence
  Description of Artificial Sequence:  Synthetic Peptide
CGDPLYGRDR

SEQ ID NO: 3199 - protein, 9 aa, Artificial Sequence
  Description of Artificial Sequence:  Synthetic Peptide
VLEAARHSY

SEQ ID NO: 3200 - protein, 9 aa, Artificial Sequence
  Description of Artificial Sequence:  Synthetic Peptide
MALPGGGVL

SEQ ID NO: 3201 - protein, 10 aa, Artificial Sequence
  Description of Artificial Sequence:  Synthetic Peptide
ALPGGGVLEA

SEQ ID NO: 3202 - protein, 9 aa, Artificial Sequence
  Description of Artificial Sequence:  Synthetic Peptide
RLTDLSQLA

SEQ ID NO: 3203 - protein, 9 aa, Artificial Sequence
  Description of Artificial Sequence:  Synthetic Peptide
SVYPNLHRL

SEQ ID NO: 3204 - protein, 9 aa, Artificial Sequence
  Description of Artificial Sequence:  Synthetic Peptide
RGRSVYPNL

SEQ ID NO: 3205 - protein, 9 aa, Artificial Sequence
  Description of Artificial Sequence:  Synthetic Peptide
RGRSVYPNL

SEQ ID NO: 3206 - protein, 9 aa, Artificial Sequence
  Description of Artificial Sequence:  Synthetic Peptide
SVYPNLHRL

SEQ ID NO: 3207 - protein, 10 aa, Artificial Sequence
  Description of Artificial Sequence:  Synthetic Peptide
RLTDLSQLAV

SEQ ID NO: 3208 - protein, 10 aa, Artificial Sequence
  Description of Artificial Sequence:  Synthetic Peptide
RSVYPNLHRL

SEQ ID NO: 3209 - protein, 10 aa, Artificial Sequence
  Description of Artificial Sequence:  Synthetic Peptide
VTRAKMEPPL

SEQ ID NO: 3210 - protein, 10 aa, Artificial Sequence
  Description of Artificial Sequence:  Synthetic Peptide
RSVYPNLHRL

SEQ ID NO: 3211 - protein, 9 aa, Artificial Sequence
  Description of Artificial Sequence:  Synthetic Peptide
ASRSRQNQI

SEQ ID NO: 3212 - protein, 9 aa, Artificial Sequence
  Description of Artificial Sequence:  Synthetic Peptide
ASRSRQNQI

SEQ ID NO: 3213 - protein, 9 aa, Artificial Sequence
  Description of Artificial Sequence:  Synthetic Peptide
SFLRHAATL

SEQ ID NO: 3214 - protein, 9 aa, Artificial Sequence
  Description of Artificial Sequence:  Synthetic Peptide
LARSLARTL

SEQ ID NO: 3215 - protein, 9 aa, Artificial Sequence
  Description of Artificial Sequence:  Synthetic Peptide
FLRHAATLL

SEQ ID NO: 3216 - protein, 9 aa, Artificial Sequence
  Description of Artificial Sequence:  Synthetic Peptide
ALPPLARSL

SEQ ID NO: 3217 - protein, 9 aa, Artificial Sequence
  Description of Artificial Sequence:  Synthetic Peptide
LARSLARTL

SEQ ID NO: 3218 - protein, 10 aa, Artificial Sequence
  Description of Artificial Sequence:  Synthetic Peptide
SFLRHAATLL

SEQ ID NO: 3219 - protein, 10 aa, Artificial Sequence
  Description of Artificial Sequence:  Synthetic Peptide
LARTLRARCL

SEQ ID NO: 3220 - protein, 10 aa, Artificial Sequence
  Description of Artificial Sequence:  Synthetic Peptide
AALPPLARSL

SEQ ID NO: 3221 - protein, 10 aa, Artificial Sequence
  Description of Artificial Sequence:  Synthetic Peptide
LARTLRARCL

SEQ ID NO: 3222 - protein, 9 aa, Artificial Sequence
  Description of Artificial Sequence:  Synthetic Peptide
CLAVSHAAL

SEQ ID NO: 3223 - protein, 9 aa, Artificial Sequence
  Description of Artificial Sequence:  Synthetic Peptide
MIMLPSQEL

SEQ ID NO: 3224 - protein, 9 aa, Artificial Sequence
  Description of Artificial Sequence:  Synthetic Peptide
IMLPSQELT

SEQ ID NO: 3225 - protein, 9 aa, Artificial Sequence
  Description of Artificial Sequence:  Synthetic Peptide
MIMLPSQEL

SEQ ID NO: 3226 - protein, 9 aa, Artificial Sequence
  Description of Artificial Sequence:  Synthetic Peptide
QELTGVCLA

SEQ ID NO: 3227 - protein, 10 aa, Artificial Sequence
  Description of Artificial Sequence:  Synthetic Peptide
MLPSQELTGV

SEQ ID NO: 3228 - protein, 10 aa, Artificial Sequence
  Description of Artificial Sequence:  Synthetic Peptide
QELTGVCLAV

SEQ ID NO: 3229 - protein, 9 aa, Artificial Sequence
  Description of Artificial Sequence:  Synthetic Peptide
YLVIASVKA

SEQ ID NO: 3230 - protein, 9 aa, Artificial Sequence
  Description of Artificial Sequence:  Synthetic Peptide
AARQAARAL

SEQ ID NO: 3231 - protein, 9 aa, Artificial Sequence
  Description of Artificial Sequence:  Synthetic Peptide
AASSWTPAL

SEQ ID NO: 3232 - protein, 9 aa, Artificial Sequence
  Description of Artificial Sequence:  Synthetic Peptide
LVIASVKAL

SEQ ID NO: 3233 - protein, 9 aa, Artificial Sequence
  Description of Artificial Sequence:  Synthetic Peptide
IASVKALRL

SEQ ID NO: 3234 - protein, 9 aa, Artificial Sequence
  Description of Artificial Sequence:  Synthetic Peptide
AARQAARAL

SEQ ID NO: 3235 - protein, 9 aa, Artificial Sequence
  Description of Artificial Sequence:  Synthetic Peptide
IASVKALRL

SEQ ID NO: 3236 - protein, 9 aa, Artificial Sequence
  Description of Artificial Sequence:  Synthetic Peptide
AEYLVIASV

SEQ ID NO: 3237 - protein, 10 aa, Artificial Sequence
  Description of Artificial Sequence:  Synthetic Peptide
YLVIASVKAL

SEQ ID NO: 3238 - protein, 10 aa, Artificial Sequence
  Description of Artificial Sequence:  Synthetic Peptide
AARQAARALM

SEQ ID NO: 3239 - protein, 10 aa, Artificial Sequence
  Description of Artificial Sequence:  Synthetic Peptide
LAASSWTPAL

SEQ ID NO: 3240 - protein, 10 aa, Artificial Sequence
  Description of Artificial Sequence:  Synthetic Peptide
AARQAARALM

SEQ ID NO: 3241 - protein, 10 aa, Artificial Sequence
  Description of Artificial Sequence:  Synthetic Peptide
SPGGAEYLVI

SEQ ID NO: 3242 - protein, 10 aa, Artificial Sequence
  Description of Artificial Sequence:  Synthetic Peptide
SPHTSMVQSW

SEQ ID NO: 3243 - protein, 9 aa, Artificial Sequence
  Description of Artificial Sequence:  Synthetic Peptide
YENPIGVFL

SEQ ID NO: 3244 - protein, 9 aa, Artificial Sequence
  Description of Artificial Sequence:  Synthetic Peptide
VSYENPIGV

SEQ ID NO: 3245 - protein, 9 aa, Artificial Sequence
  Description of Artificial Sequence:  Synthetic Peptide
SYENPIGVF

SEQ ID NO: 3246 - protein, 9 aa, Artificial Sequence
  Description of Artificial Sequence:  Synthetic Peptide
SLSVTVESK

SEQ ID NO: 3247 - protein, 9 aa, Artificial Sequence
  Description of Artificial Sequence:  Synthetic Peptide
NPIGVFLDF

SEQ ID NO: 3248 - protein, 9 aa, Artificial Sequence
  Description of Artificial Sequence:  Synthetic Peptide
NSTRCPGEY

SEQ ID NO: 3249 - protein, 9 aa, Artificial Sequence
  Description of Artificial Sequence:  Synthetic Peptide
VESKQRVSY

SEQ ID NO: 3250 - protein, 9 aa, Artificial Sequence
  Description of Artificial Sequence:  Synthetic Peptide
NPIGVFLDF

SEQ ID NO: 3251 - protein, 10 aa, Artificial Sequence
  Description of Artificial Sequence:  Synthetic Peptide
TVESKQRVSY

SEQ ID NO: 3252 - protein, 10 aa, Artificial Sequence
  Description of Artificial Sequence:  Synthetic Peptide
SYENPIGVFL

SEQ ID NO: 3253 - protein, 10 aa, Artificial Sequence
  Description of Artificial Sequence:  Synthetic Peptide
VSYENPIGVF

SEQ ID NO: 3254 - protein, 9 aa, Artificial Sequence
  Description of Artificial Sequence:  Synthetic Peptide
MPEVEELPK

SEQ ID NO: 3255 - protein, 9 aa, Artificial Sequence
  Description of Artificial Sequence:  Synthetic Peptide
KAVDRVDSV

SEQ ID NO: 3256 - protein, 9 aa, Artificial Sequence
  Description of Artificial Sequence:  Synthetic Peptide
LVASSAKAV

SEQ ID NO: 3257 - protein, 9 aa, Artificial Sequence
  Description of Artificial Sequence:  Synthetic Peptide
KLLVASSAK

SEQ ID NO: 3258 - protein, 9 aa, Artificial Sequence
  Description of Artificial Sequence:  Synthetic Peptide
EELPKLLVA

SEQ ID NO: 3259 - protein, 10 aa, Artificial Sequence
  Description of Artificial Sequence:  Synthetic Peptide
LLVASSAKAV

SEQ ID NO: 3260 - protein, 10 aa, Artificial Sequence
  Description of Artificial Sequence:  Synthetic Peptide
KLLVASSAKA

SEQ ID NO: 3261 - protein, 10 aa, Artificial Sequence
  Description of Artificial Sequence:  Synthetic Peptide
MPEVEELPKL

SEQ ID NO: 3262 - protein, 10 aa, Artificial Sequence
  Description of Artificial Sequence:  Synthetic Peptide
EELPKLLVAS

SEQ ID NO: 3263 - protein, 10 aa, Artificial Sequence
  Description of Artificial Sequence:  Synthetic Peptide
DSVRTTVRFF

SEQ ID NO: 3264 - protein, 9 aa, Artificial Sequence
  Description of Artificial Sequence:  Synthetic Peptide
GGDPLANLR

SEQ ID NO: 3265 - protein, 9 aa, Artificial Sequence
  Description of Artificial Sequence:  Synthetic Peptide
NCDPTGYSW

SEQ ID NO: 3266 - protein, 9 aa, Artificial Sequence
  Description of Artificial Sequence:  Synthetic Peptide
VIWEGSVSM

SEQ ID NO: 3267 - protein, 9 aa, Artificial Sequence
  Description of Artificial Sequence:  Synthetic Peptide
CLHRRLASM

SEQ ID NO: 3268 - protein, 9 aa, Artificial Sequence
  Description of Artificial Sequence:  Synthetic Peptide
KGLQGGANL

SEQ ID NO: 3269 - protein, 9 aa, Artificial Sequence
  Description of Artificial Sequence:  Synthetic Peptide
WLAVQVALR

SEQ ID NO: 3270 - protein, 9 aa, Artificial Sequence
  Description of Artificial Sequence:  Synthetic Peptide
LATEGGDPL

SEQ ID NO: 3271 - protein, 9 aa, Artificial Sequence
  Description of Artificial Sequence:  Synthetic Peptide
RPAASAVIW

SEQ ID NO: 3272 - protein, 10 aa, Artificial Sequence
  Description of Artificial Sequence:  Synthetic Peptide
ATEGGDPLAN

SEQ ID NO: 3273 - protein, 10 aa, Artificial Sequence
  Description of Artificial Sequence:  Synthetic Peptide
ALRDGADSWL

SEQ ID NO: 3274 - protein, 10 aa, Artificial Sequence
  Description of Artificial Sequence:  Synthetic Peptide
GLQGGANLCR

SEQ ID NO: 3275 - protein, 10 aa, Artificial Sequence
  Description of Artificial Sequence:  Synthetic Peptide
MLPPISCLHR

SEQ ID NO: 3276 - protein, 10 aa, Artificial Sequence
  Description of Artificial Sequence:  Synthetic Peptide
ALRDGADSWL

SEQ ID NO: 3277 - protein, 10 aa, Artificial Sequence
  Description of Artificial Sequence:  Synthetic Peptide
AVIWEGSVSM

SEQ ID NO: 3278 - protein, 10 aa, Artificial Sequence
  Description of Artificial Sequence:  Synthetic Peptide
ALRDGADSWL

SEQ ID NO: 3279 - protein, 10 aa, Artificial Sequence
  Description of Artificial Sequence:  Synthetic Peptide
GESWLAVQVA

SEQ ID NO: 3280 - protein, 9 aa, Artificial Sequence
  Description of Artificial Sequence:  Synthetic Peptide
VLGPTILIV

SEQ ID NO: 3281 - protein, 9 aa, Artificial Sequence
  Description of Artificial Sequence:  Synthetic Peptide
GMSLAFSQV

SEQ ID NO: 3282 - protein, 9 aa, Artificial Sequence
  Description of Artificial Sequence:  Synthetic Peptide
FLTCPVISA

SEQ ID NO: 3283 - protein, 9 aa, Artificial Sequence
  Description of Artificial Sequence:  Synthetic Peptide
FLQVLGPTI

SEQ ID NO: 3284 - protein, 9 aa, Artificial Sequence
  Description of Artificial Sequence:  Synthetic Peptide
TILIVPFLT

SEQ ID NO: 3285 - protein, 9 aa, Artificial Sequence
  Description of Artificial Sequence:  Synthetic Peptide
LLSMAVTRA

SEQ ID NO: 3286 - protein, 9 aa, Artificial Sequence
  Description of Artificial Sequence:  Synthetic Peptide
ILIVPFLTC

SEQ ID NO: 3287 - protein, 9 aa, Artificial Sequence
  Description of Artificial Sequence:  Synthetic Peptide
WCSRLRSWV

SEQ ID NO: 3288 - protein, 9 aa, Artificial Sequence
  Description of Artificial Sequence:  Synthetic Peptide
IVPFLTCPV

SEQ ID NO: 3289 - protein, 9 aa, Artificial Sequence
  Description of Artificial Sequence:  Synthetic Peptide
AFSQVLKSL

SEQ ID NO: 3290 - protein, 9 aa, Artificial Sequence
  Description of Artificial Sequence:  Synthetic Peptide
RLRSWVTVR

SEQ ID NO: 3291 - protein, 9 aa, Artificial Sequence
  Description of Artificial Sequence:  Synthetic Peptide
SLAFSQVLK

SEQ ID NO: 3292 - protein, 9 aa, Artificial Sequence
  Description of Artificial Sequence:  Synthetic Peptide
APQWQRVCM

SEQ ID NO: 3293 - protein, 9 aa, Artificial Sequence
  Description of Artificial Sequence:  Synthetic Peptide
MPSPRQTPL

SEQ ID NO: 3294 - protein, 9 aa, Artificial Sequence
  Description of Artificial Sequence:  Synthetic Peptide
IPGSCGMSL

SEQ ID NO: 3295 - protein, 9 aa, Artificial Sequence
  Description of Artificial Sequence:  Synthetic Peptide
AVTRAAASL

SEQ ID NO: 3296 - protein, 9 aa, Artificial Sequence
  Description of Artificial Sequence:  Synthetic Peptide
TVRLLSMAV

SEQ ID NO: 3297 - protein, 9 aa, Artificial Sequence
  Description of Artificial Sequence:  Synthetic Peptide
MPSPRQTPL

SEQ ID NO: 3298 - protein, 9 aa, Artificial Sequence
  Description of Artificial Sequence:  Synthetic Peptide
APQWQRVCM

SEQ ID NO: 3299 - protein, 9 aa, Artificial Sequence
  Description of Artificial Sequence:  Synthetic Peptide
MPSPRQTPL

SEQ ID NO: 3300 - protein, 9 aa, Artificial Sequence
  Description of Artificial Sequence:  Synthetic Peptide
GPTILIVPF

SEQ ID NO: 3301 - protein, 9 aa, Artificial Sequence
  Description of Artificial Sequence:  Synthetic Peptide
IPGSCGMSL

SEQ ID NO: 3302 - protein, 9 aa, Artificial Sequence
  Description of Artificial Sequence:  Synthetic Peptide
CPVISAPQW

SEQ ID NO: 3303 - protein, 9 aa, Artificial Sequence
  Description of Artificial Sequence:  Synthetic Peptide
RSWVTVRLL

SEQ ID NO: 3304 - protein, 10 aa, Artificial Sequence
  Description of Artificial Sequence:  Synthetic Peptide
HSELIHWCSR

SEQ ID NO: 3305 - protein, 10 aa, Artificial Sequence
  Description of Artificial Sequence:  Synthetic Peptide
SLSQEPEHGV

SEQ ID NO: 3306 - protein, 10 aa, Artificial Sequence
  Description of Artificial Sequence:  Synthetic Peptide
RLLSMAVTRA

SEQ ID NO: 3307 - protein, 10 aa, Artificial Sequence
  Description of Artificial Sequence:  Synthetic Peptide
KVPLHMFLQV

SEQ ID NO: 3308 - protein, 10 aa, Artificial Sequence
  Description of Artificial Sequence:  Synthetic Peptide
FLQVLGPTIL

SEQ ID NO: 3309 - protein, 10 aa, Artificial Sequence
  Description of Artificial Sequence:  Synthetic Peptide
VISAPQWQRV

SEQ ID NO: 3310 - protein, 10 aa, Artificial Sequence
  Description of Artificial Sequence:  Synthetic Peptide
MMPSPRQTPL

SEQ ID NO: 3311 - protein, 10 aa, Artificial Sequence
  Description of Artificial Sequence:  Synthetic Peptide
GMSLAFSQVL

SEQ ID NO: 3312 - protein, 10 aa, Artificial Sequence
  Description of Artificial Sequence:  Synthetic Peptide
QVLGPTILIV

SEQ ID NO: 3313 - protein, 10 aa, Artificial Sequence
  Description of Artificial Sequence:  Synthetic Peptide
RLRSWVTVRL

SEQ ID NO: 3314 - protein, 10 aa, Artificial Sequence
  Description of Artificial Sequence:  Synthetic Peptide
PLYPRWQDTK

SEQ ID NO: 3315 - protein, 10 aa, Artificial Sequence
  Description of Artificial Sequence:  Synthetic Peptide
GPTILIVPFL

SEQ ID NO: 3316 - protein, 10 aa, Artificial Sequence
  Description of Artificial Sequence:  Synthetic Peptide
VPLHMFLQVL

SEQ ID NO: 3317 - protein, 10 aa, Artificial Sequence
  Description of Artificial Sequence:  Synthetic Peptide
YPRWQDTKGI

SEQ ID NO: 3318 - protein, 10 aa, Artificial Sequence
  Description of Artificial Sequence:  Synthetic Peptide
APQWQRVCMM

SEQ ID NO: 3319 - protein, 10 aa, Artificial Sequence
  Description of Artificial Sequence:  Synthetic Peptide
RLRSWVTVRL

SEQ ID NO: 3320 - protein, 10 aa, Artificial Sequence
  Description of Artificial Sequence:  Synthetic Peptide
LAFSQVLKSL

SEQ ID NO: 3321 - protein, 10 aa, Artificial Sequence
  Description of Artificial Sequence:  Synthetic Peptide
MAVTRAAASL

SEQ ID NO: 3322 - protein, 10 aa, Artificial Sequence
  Description of Artificial Sequence:  Synthetic Peptide
APQWQRVCMM

SEQ ID NO: 3323 - protein, 10 aa, Artificial Sequence
  Description of Artificial Sequence:  Synthetic Peptide
MPSPRQTPLY

SEQ ID NO: 3324 - protein, 10 aa, Artificial Sequence
  Description of Artificial Sequence:  Synthetic Peptide
YPRWQDTKGI

SEQ ID NO: 3325 - protein, 10 aa, Artificial Sequence
  Description of Artificial Sequence:  Synthetic Peptide
VPLHMFLQVL

SEQ ID NO: 3326 - protein, 10 aa, Artificial Sequence
  Description of Artificial Sequence:  Synthetic Peptide
GPTILIVPFL

SEQ ID NO: 3327 - protein, 10 aa, Artificial Sequence
  Description of Artificial Sequence:  Synthetic Peptide
SELIHWCSRL

SEQ ID NO: 3328 - protein, 10 aa, Artificial Sequence
  Description of Artificial Sequence:  Synthetic Peptide
QEPEHGVVHS

SEQ ID NO: 3329 - protein, 9 aa, Artificial Sequence
  Description of Artificial Sequence:  Synthetic Peptide
ATHPPNMLK

SEQ ID NO: 3330 - protein, 9 aa, Artificial Sequence
  Description of Artificial Sequence:  Synthetic Peptide
NMLKRRVWL

SEQ ID NO: 3331 - protein, 9 aa, Artificial Sequence
  Description of Artificial Sequence:  Synthetic Peptide
KVSSFCQLV

SEQ ID NO: 3332 - protein, 9 aa, Artificial Sequence
  Description of Artificial Sequence:  Synthetic Peptide
MLKRRVWLV

SEQ ID NO: 3333 - protein, 9 aa, Artificial Sequence
  Description of Artificial Sequence:  Synthetic Peptide
RVWLVVSGL

SEQ ID NO: 3334 - protein, 9 aa, Artificial Sequence
  Description of Artificial Sequence:  Synthetic Peptide
AINEAMAGL

SEQ ID NO: 3335 - protein, 9 aa, Artificial Sequence
  Description of Artificial Sequence:  Synthetic Peptide
WLVVSGLVT

SEQ ID NO: 3336 - protein, 9 aa, Artificial Sequence
  Description of Artificial Sequence:  Synthetic Peptide
KYCIPLMKF

SEQ ID NO: 3337 - protein, 9 aa, Artificial Sequence
  Description of Artificial Sequence:  Synthetic Peptide
RVWLVVSGL

SEQ ID NO: 3338 - protein, 9 aa, Artificial Sequence
  Description of Artificial Sequence:  Synthetic Peptide
CFAQKVSSF

SEQ ID NO: 3339 - protein, 9 aa, Artificial Sequence
  Description of Artificial Sequence:  Synthetic Peptide
TLPMAAPAK

SEQ ID NO: 3340 - protein, 9 aa, Artificial Sequence
  Description of Artificial Sequence:  Synthetic Peptide
APYPARMSM

SEQ ID NO: 3341 - protein, 9 aa, Artificial Sequence
  Description of Artificial Sequence:  Synthetic Peptide
KPAKYCIPL

SEQ ID NO: 3342 - protein, 9 aa, Artificial Sequence
  Description of Artificial Sequence:  Synthetic Peptide
AATHPPNML

SEQ ID NO: 3343 - protein, 9 aa, Artificial Sequence
  Description of Artificial Sequence:  Synthetic Peptide
RVWLVVSGL

SEQ ID NO: 3344 - protein, 9 aa, Artificial Sequence
  Description of Artificial Sequence:  Synthetic Peptide
TPAPYPARM

SEQ ID NO: 3345 - protein, 9 aa, Artificial Sequence
  Description of Artificial Sequence:  Synthetic Peptide
AVKAINEAM

SEQ ID NO: 3346 - protein, 9 aa, Artificial Sequence
  Description of Artificial Sequence:  Synthetic Peptide
AINEAMAGL

SEQ ID NO: 3347 - protein, 9 aa, Artificial Sequence
  Description of Artificial Sequence:  Synthetic Peptide
MLKRRVWLV

SEQ ID NO: 3348 - protein, 9 aa, Artificial Sequence
  Description of Artificial Sequence:  Synthetic Peptide
APYPARMSM

SEQ ID NO: 3349 - protein, 9 aa, Artificial Sequence
  Description of Artificial Sequence:  Synthetic Peptide
TPAPYPARM

SEQ ID NO: 3350 - protein, 9 aa, Artificial Sequence
  Description of Artificial Sequence:  Synthetic Peptide
KPAKYCIPL

SEQ ID NO: 3351 - protein, 9 aa, Artificial Sequence
  Description of Artificial Sequence:  Synthetic Peptide
GSVDKPAKY

SEQ ID NO: 3352 - protein, 9 aa, Artificial Sequence
  Description of Artificial Sequence:  Synthetic Peptide
RAPATPAPY

SEQ ID NO: 3353 - protein, 9 aa, Artificial Sequence
  Description of Artificial Sequence:  Synthetic Peptide
SSVEGTSPL

SEQ ID NO: 3354 - protein, 9 aa, Artificial Sequence
  Description of Artificial Sequence:  Synthetic Peptide
GSVDKPAKY

SEQ ID NO: 3355 - protein, 10 aa, Artificial Sequence
  Description of Artificial Sequence:  Synthetic Peptide
ATHPPNMLKR

SEQ ID NO: 3356 - protein, 10 aa, Artificial Sequence
  Description of Artificial Sequence:  Synthetic Peptide
NMLKRRVWLV

SEQ ID NO: 3357 - protein, 10 aa, Artificial Sequence
  Description of Artificial Sequence:  Synthetic Peptide
WLVVSGLVTA

SEQ ID NO: 3358 - protein, 10 aa, Artificial Sequence
  Description of Artificial Sequence:  Synthetic Peptide
GLVTAAVKAI

SEQ ID NO: 3359 - protein, 10 aa, Artificial Sequence
  Description of Artificial Sequence:  Synthetic Peptide
ILNATRAPAT

SEQ ID NO: 3360 - protein, 10 aa, Artificial Sequence
  Description of Artificial Sequence:  Synthetic Peptide
VVSGLVTAAV

SEQ ID NO: 3361 - protein, 10 aa, Artificial Sequence
  Description of Artificial Sequence:  Synthetic Peptide
KAINEAMAGL

SEQ ID NO: 3362 - protein, 10 aa, Artificial Sequence
  Description of Artificial Sequence:  Synthetic Peptide
SMRTFPSPTL

SEQ ID NO: 3363 - protein, 10 aa, Artificial Sequence
  Description of Artificial Sequence:  Synthetic Peptide
KPAKYCIPLM

SEQ ID NO: 3364 - protein, 10 aa, Artificial Sequence
  Description of Artificial Sequence:  Synthetic Peptide
WAATHPPNML

SEQ ID NO: 3365 - protein, 10 aa, Artificial Sequence
  Description of Artificial Sequence:  Synthetic Peptide
KAINEAMAGL

SEQ ID NO: 3366 - protein, 10 aa, Artificial Sequence
  Description of Artificial Sequence:  Synthetic Peptide
AQKVSSFCQL

SEQ ID NO: 3367 - protein, 10 aa, Artificial Sequence
  Description of Artificial Sequence:  Synthetic Peptide
KPAKYCIPLM

SEQ ID NO: 3368 - protein, 10 aa, Artificial Sequence
  Description of Artificial Sequence:  Synthetic Peptide
IPLMKFHICF

SEQ ID NO: 3369 - protein, 10 aa, Artificial Sequence
  Description of Artificial Sequence:  Synthetic Peptide
YPARMSMRTF

SEQ ID NO: 3370 - protein, 10 aa, Artificial Sequence
  Description of Artificial Sequence:  Synthetic Peptide
SSVEGTSPLM

SEQ ID NO: 3371 - protein, 10 aa, Artificial Sequence
  Description of Artificial Sequence:  Synthetic Peptide
RSSVEGTSPL

SEQ ID NO: 3372 - protein, 10 aa, Artificial Sequence
  Description of Artificial Sequence:  Synthetic Peptide
NEAMAGLPGS

SEQ ID NO: 3373 - protein, 9 aa, Artificial Sequence
  Description of Artificial Sequence:  Synthetic Peptide
SADMHVMMY

SEQ ID NO: 3374 - protein, 9 aa, Artificial Sequence
  Description of Artificial Sequence:  Synthetic Peptide
TTQPVDRQY

SEQ ID NO: 3375 - protein, 9 aa, Artificial Sequence
  Description of Artificial Sequence:  Synthetic Peptide
YLVTGCVRV

SEQ ID NO: 3376 - protein, 9 aa, Artificial Sequence
  Description of Artificial Sequence:  Synthetic Peptide
VMMYLVTGC

SEQ ID NO: 3377 - protein, 9 aa, Artificial Sequence
  Description of Artificial Sequence:  Synthetic Peptide
MMYLVTGCV

SEQ ID NO: 3378 - protein, 9 aa, Artificial Sequence
  Description of Artificial Sequence:  Synthetic Peptide
TPPTSTQVL

SEQ ID NO: 3379 - protein, 9 aa, Artificial Sequence
  Description of Artificial Sequence:  Synthetic Peptide
AARTPPTST

SEQ ID NO: 3380 - protein, 9 aa, Artificial Sequence
  Description of Artificial Sequence:  Synthetic Peptide
AGFPDKTTL

SEQ ID NO: 3381 - protein, 9 aa, Artificial Sequence
  Description of Artificial Sequence:  Synthetic Peptide
RSADMHVMM

SEQ ID NO: 3382 - protein, 9 aa, Artificial Sequence
  Description of Artificial Sequence:  Synthetic Peptide
TPPTSTQVL

SEQ ID NO: 3383 - protein, 9 aa, Artificial Sequence
  Description of Artificial Sequence:  Synthetic Peptide
SADMHVMMY

SEQ ID NO: 3384 - protein, 10 aa, Artificial Sequence
  Description of Artificial Sequence:  Synthetic Peptide
TLPTMTTQPV

SEQ ID NO: 3385 - protein, 10 aa, Artificial Sequence
  Description of Artificial Sequence:  Synthetic Peptide
VMMYLVTGCV

SEQ ID NO: 3386 - protein, 10 aa, Artificial Sequence
  Description of Artificial Sequence:  Synthetic Peptide
RTPPTSTQVL

SEQ ID NO: 3387 - protein, 10 aa, Artificial Sequence
  Description of Artificial Sequence:  Synthetic Peptide
MMYLVTGCVR

SEQ ID NO: 3388 - protein, 10 aa, Artificial Sequence
  Description of Artificial Sequence:  Synthetic Peptide
IAGFPDKTTL

SEQ ID NO: 3389 - protein, 10 aa, Artificial Sequence
  Description of Artificial Sequence:  Synthetic Peptide
TSRSADMHVM

SEQ ID NO: 3390 - protein, 10 aa, Artificial Sequence
  Description of Artificial Sequence:  Synthetic Peptide
AAKAARTPPT

SEQ ID NO: 3391 - protein, 10 aa, Artificial Sequence
  Description of Artificial Sequence:  Synthetic Peptide
TSRSADMHVM

SEQ ID NO: 3392 - protein, 10 aa, Artificial Sequence
  Description of Artificial Sequence:  Synthetic Peptide
RSADMHVMMY

SEQ ID NO: 3393 - protein, 10 aa, Artificial Sequence
  Description of Artificial Sequence:  Synthetic Peptide
FPDKTTLPTM

SEQ ID NO: 3394 - protein, 10 aa, Artificial Sequence
  Description of Artificial Sequence:  Synthetic Peptide
RSADMHVMMY

SEQ ID NO: 3395 - protein, 9 aa, Artificial Sequence
  Description of Artificial Sequence:  Synthetic Peptide
SLTVVSAGV

SEQ ID NO: 3396 - protein, 10 aa, Artificial Sequence
  Description of Artificial Sequence:  Synthetic Peptide
EGRSPGATNL

SEQ ID NO: 3397 - protein, 9 aa, Artificial Sequence
  Description of Artificial Sequence:  Synthetic Peptide
MPGFPLPVL

SEQ ID NO: 3398 - protein, 9 aa, Artificial Sequence
  Description of Artificial Sequence:  Synthetic Peptide
MPGFPLPVL

SEQ ID NO: 3399 - protein, 9 aa, Artificial Sequence
  Description of Artificial Sequence:  Synthetic Peptide
SITESKSPV

SEQ ID NO: 3400 - protein, 9 aa, Artificial Sequence
  Description of Artificial Sequence:  Synthetic Peptide
VLQSITESK

SEQ ID NO: 3401 - protein, 10 aa, Artificial Sequence
  Description of Artificial Sequence:  Synthetic Peptide
KVGSRLKSTV

SEQ ID NO: 3402 - protein, 10 aa, Artificial Sequence
  Description of Artificial Sequence:  Synthetic Peptide
KSTVWVTHVL

SEQ ID NO: 3403 - protein, 10 aa, Artificial Sequence
  Description of Artificial Sequence:  Synthetic Peptide
KSTVWVTHVL

SEQ ID NO: 3404 - protein, 9 aa, Artificial Sequence
  Description of Artificial Sequence:  Synthetic Peptide
VATTTTSPL

SEQ ID NO: 3405 - protein, 10 aa, Artificial Sequence
  Description of Artificial Sequence:  Synthetic Peptide
SVATTTTSPL

SEQ ID NO: 3406 - protein, 9 aa, Artificial Sequence
  Description of Artificial Sequence:  Synthetic Peptide
SFAASSSHF

SEQ ID NO: 3407 - protein, 10 aa, Artificial Sequence
  Description of Artificial Sequence:  Synthetic Peptide
SFAASSSHFF

SEQ ID NO: 3408 - protein, 9 aa, Artificial Sequence
  Description of Artificial Sequence:  Synthetic Peptide
VTEPGGVAV

SEQ ID NO: 3409 - protein, 9 aa, Artificial Sequence
  Description of Artificial Sequence:  Synthetic Peptide
VAVASTTSL

SEQ ID NO: 3410 - protein, 9 aa, Artificial Sequence
  Description of Artificial Sequence:  Synthetic Peptide
MPKMDVASV

SEQ ID NO: 3411 - protein, 9 aa, Artificial Sequence
  Description of Artificial Sequence:  Synthetic Peptide
TEPGGVAVA

SEQ ID NO: 3412 - protein, 10 aa, Artificial Sequence
  Description of Artificial Sequence:  Synthetic Peptide
VTEPGGVAVA

SEQ ID NO: 3413 - protein, 10 aa, Artificial Sequence
  Description of Artificial Sequence:  Synthetic Peptide
TVTEPGGVAV

SEQ ID NO: 3414 - protein, 10 aa, Artificial Sequence
  Description of Artificial Sequence:  Synthetic Peptide
GVAVASTTSL

SEQ ID NO: 3415 - protein, 10 aa, Artificial Sequence
  Description of Artificial Sequence:  Synthetic Peptide
WSRTVPMPKM

SEQ ID NO: 3416 - protein, 10 aa, Artificial Sequence
  Description of Artificial Sequence:  Synthetic Peptide
WSRTVPMPKM

SEQ ID NO: 3417 - protein, 10 aa, Artificial Sequence
  Description of Artificial Sequence:  Synthetic Peptide
VSAWSRTVPM

SEQ ID NO: 3418 - protein, 10 aa, Artificial Sequence
  Description of Artificial Sequence:  Synthetic Peptide
TEPGGVAVAS

SEQ ID NO: 3419 - protein, 9 aa, Artificial Sequence
  Description of Artificial Sequence:  Synthetic Peptide
IVLTPVLML

SEQ ID NO: 3420 - protein, 9 aa, Artificial Sequence
  Description of Artificial Sequence:  Synthetic Peptide
GLPVVIVLT

SEQ ID NO: 3421 - protein, 9 aa, Artificial Sequence
  Description of Artificial Sequence:  Synthetic Peptide
MGLPVVIVL

SEQ ID NO: 3422 - protein, 9 aa, Artificial Sequence
  Description of Artificial Sequence:  Synthetic Peptide
IVLTPVLML

SEQ ID NO: 3423 - protein, 9 aa, Artificial Sequence
  Description of Artificial Sequence:  Synthetic Peptide
VVIVLTPVL

SEQ ID NO: 3424 - protein, 10 aa, Artificial Sequence
  Description of Artificial Sequence:  Synthetic Peptide
VIVLTPVLML

SEQ ID NO: 3425 - protein, 9 aa, Artificial Sequence
  Description of Artificial Sequence:  Synthetic Peptide
TPRVHTAAL

SEQ ID NO: 3426 - protein, 9 aa, Artificial Sequence
  Description of Artificial Sequence:  Synthetic Peptide
TPRVHTAAL

SEQ ID NO: 3427 - protein, 9 aa, Artificial Sequence
  Description of Artificial Sequence:  Synthetic Peptide
TPRVHTAAL

SEQ ID NO: 3428 - protein, 10 aa, Artificial Sequence
  Description of Artificial Sequence:  Synthetic Peptide
ALATPRVHTA

SEQ ID NO: 3429 - protein, 10 aa, Artificial Sequence
  Description of Artificial Sequence:  Synthetic Peptide
ATPRVHTAAL

SEQ ID NO: 3430 - protein, 9 aa, Artificial Sequence
  Description of Artificial Sequence:  Synthetic Peptide
SPRRRTGMT

SEQ ID NO: 3431 - protein, 9 aa, Artificial Sequence
  Description of Artificial Sequence:  Synthetic Peptide
SPRRRTGMT

SEQ ID NO: 3432 - protein, 9 aa, Artificial Sequence
  Description of Artificial Sequence:  Synthetic Peptide
LSPRRRTGM

SEQ ID NO: 3433 - protein, 10 aa, Artificial Sequence
  Description of Artificial Sequence:  Synthetic Peptide
GMTSACLVTR

SEQ ID NO: 3434 - protein, 10 aa, Artificial Sequence
  Description of Artificial Sequence:  Synthetic Peptide
MGRGDSRLPL

SEQ ID NO: 3435 - protein, 9 aa, Artificial Sequence
  Description of Artificial Sequence:  Synthetic Peptide
PLGDAMVLV

SEQ ID NO: 3436 - protein, 9 aa, Artificial Sequence
  Description of Artificial Sequence:  Synthetic Peptide
GPLGDAMVL

SEQ ID NO: 3437 - protein, 9 aa, Artificial Sequence
  Description of Artificial Sequence:  Synthetic Peptide
GPLGDAMVL

SEQ ID NO: 3438 - protein, 9 aa, Artificial Sequence
  Description of Artificial Sequence:  Synthetic Peptide
LMMSPHAAV

SEQ ID NO: 3439 - protein, 9 aa, Artificial Sequence
  Description of Artificial Sequence:  Synthetic Peptide
FLSRPVRLV

SEQ ID NO: 3440 - protein, 9 aa, Artificial Sequence
  Description of Artificial Sequence:  Synthetic Peptide
IMHPRRPLV

SEQ ID NO: 3441 - protein, 9 aa, Artificial Sequence
  Description of Artificial Sequence:  Synthetic Peptide
WTSPSTWFL

SEQ ID NO: 3442 - protein, 9 aa, Artificial Sequence
  Description of Artificial Sequence:  Synthetic Peptide
KVWAAVDTI

SEQ ID NO: 3443 - protein, 9 aa, Artificial Sequence
  Description of Artificial Sequence:  Synthetic Peptide
WFLSRPVRL

SEQ ID NO: 3444 - protein, 9 aa, Artificial Sequence
  Description of Artificial Sequence:  Synthetic Peptide
GPSSISRPL

SEQ ID NO: 3445 - protein, 9 aa, Artificial Sequence
  Description of Artificial Sequence:  Synthetic Peptide
QSRRGVRWL

SEQ ID NO: 3446 - protein, 9 aa, Artificial Sequence
  Description of Artificial Sequence:  Synthetic Peptide
VIMHPRRPL

SEQ ID NO: 3447 - protein, 9 aa, Artificial Sequence
  Description of Artificial Sequence:  Synthetic Peptide
ATARSRKPL

SEQ ID NO: 3448 - protein, 9 aa, Artificial Sequence
  Description of Artificial Sequence:  Synthetic Peptide
YAVMGASNL

SEQ ID NO: 3449 - protein, 9 aa, Artificial Sequence
  Description of Artificial Sequence:  Synthetic Peptide
TARSRKPLC

SEQ ID NO: 3450 - protein, 9 aa, Artificial Sequence
  Description of Artificial Sequence:  Synthetic Peptide
HPRRPLVCW

SEQ ID NO: 3451 - protein, 9 aa, Artificial Sequence
  Description of Artificial Sequence:  Synthetic Peptide
GPSSISRPL

SEQ ID NO: 3452 - protein, 9 aa, Artificial Sequence
  Description of Artificial Sequence:  Synthetic Peptide
QSRRGVRWL

SEQ ID NO: 3453 - protein, 9 aa, Artificial Sequence
  Description of Artificial Sequence:  Synthetic Peptide
AETGKPLMM

SEQ ID NO: 3454 - protein, 10 aa, Artificial Sequence
  Description of Artificial Sequence:  Synthetic Peptide
VMGASNLQPL

SEQ ID NO: 3455 - protein, 10 aa, Artificial Sequence
  Description of Artificial Sequence:  Synthetic Peptide
VIMHPRRPLV

SEQ ID NO: 3456 - protein, 10 aa, Artificial Sequence
  Description of Artificial Sequence:  Synthetic Peptide
FLSRPVRLVI

SEQ ID NO: 3457 - protein, 10 aa, Artificial Sequence
  Description of Artificial Sequence:  Synthetic Peptide
AYAVMGASNL

SEQ ID NO: 3458 - protein, 10 aa, Artificial Sequence
  Description of Artificial Sequence:  Synthetic Peptide
VMSLVSIWEK

SEQ ID NO: 3459 - protein, 10 aa, Artificial Sequence
  Description of Artificial Sequence:  Synthetic Peptide
AVSAPHVMSL

SEQ ID NO: 3460 - protein, 10 aa, Artificial Sequence
  Description of Artificial Sequence:  Synthetic Peptide
LVIMHPRRPL

SEQ ID NO: 3461 - protein, 10 aa, Artificial Sequence
  Description of Artificial Sequence:  Synthetic Peptide
APHVMSLVSI

SEQ ID NO: 3462 - protein, 10 aa, Artificial Sequence
  Description of Artificial Sequence:  Synthetic Peptide
HPRRPLVCWA

SEQ ID NO: 3463 - protein, 10 aa, Artificial Sequence
  Description of Artificial Sequence:  Synthetic Peptide
TATARSRKPL

SEQ ID NO: 3464 - protein, 10 aa, Artificial Sequence
  Description of Artificial Sequence:  Synthetic Peptide
AQSRRGVRWL

SEQ ID NO: 3465 - protein, 10 aa, Artificial Sequence
  Description of Artificial Sequence:  Synthetic Peptide
AGPSSISRPL

SEQ ID NO: 3466 - protein, 10 aa, Artificial Sequence
  Description of Artificial Sequence:  Synthetic Peptide
LSRPVRLVIM

SEQ ID NO: 3467 - protein, 10 aa, Artificial Sequence
  Description of Artificial Sequence:  Synthetic Peptide
LSRPVRLVIM

SEQ ID NO: 3468 - protein, 10 aa, Artificial Sequence
  Description of Artificial Sequence:  Synthetic Peptide
TARSRKPLCA

SEQ ID NO: 3469 - protein, 10 aa, Artificial Sequence
  Description of Artificial Sequence:  Synthetic Peptide
LSRPVRLVIM

SEQ ID NO: 3470 - protein, 10 aa, Artificial Sequence
  Description of Artificial Sequence:  Synthetic Peptide
AETGKPLMMS

SEQ ID NO: 3471 - protein, 9 aa, Artificial Sequence
  Description of Artificial Sequence:  Synthetic Peptide
KMTASRPPR

SEQ ID NO: 3472 - protein, 9 aa, Artificial Sequence
  Description of Artificial Sequence:  Synthetic Peptide
CASTLVRKY

SEQ ID NO: 3473 - protein, 10 aa, Artificial Sequence
  Description of Artificial Sequence:  Synthetic Peptide
KMTASRPPRT

SEQ ID NO: 3474 - protein, 10 aa, Artificial Sequence
  Description of Artificial Sequence:  Synthetic Peptide
RPPRTLRGGI

SEQ ID NO: 3475 - protein, 10 aa, Artificial Sequence
  Description of Artificial Sequence:  Synthetic Peptide
NTRVGCTAHM

SEQ ID NO: 3476 - protein, 10 aa, Artificial Sequence
  Description of Artificial Sequence:  Synthetic Peptide
RPPRTLRGGI

SEQ ID NO: 3477 - protein, 10 aa, Artificial Sequence
  Description of Artificial Sequence:  Synthetic Peptide
SCASTLVRKY

SEQ ID NO: 3478 - protein, 9 aa, Artificial Sequence
  Description of Artificial Sequence:  Synthetic Peptide
MLDPTPYKY

SEQ ID NO: 3479 - protein, 9 aa, Artificial Sequence
  Description of Artificial Sequence:  Synthetic Peptide
VQLQAASSL

SEQ ID NO: 3480 - protein, 9 aa, Artificial Sequence
  Description of Artificial Sequence:  Synthetic Peptide
TYILILNIV

SEQ ID NO: 3481 - protein, 9 aa, Artificial Sequence
  Description of Artificial Sequence:  Synthetic Peptide
KYCTSTMFW

SEQ ID NO: 3482 - protein, 9 aa, Artificial Sequence
  Description of Artificial Sequence:  Synthetic Peptide
TMFWWRWMR

SEQ ID NO: 3483 - protein, 9 aa, Artificial Sequence
  Description of Artificial Sequence:  Synthetic Peptide
AMLDPTPYK

SEQ ID NO: 3484 - protein, 9 aa, Artificial Sequence
  Description of Artificial Sequence:  Synthetic Peptide
MLDPTPYKY

SEQ ID NO: 3485 - protein, 9 aa, Artificial Sequence
  Description of Artificial Sequence:  Synthetic Peptide
SQRSPRVQL

SEQ ID NO: 3486 - protein, 9 aa, Artificial Sequence
  Description of Artificial Sequence:  Synthetic Peptide
TPPTYILIL

SEQ ID NO: 3487 - protein, 9 aa, Artificial Sequence
  Description of Artificial Sequence:  Synthetic Peptide
SPRVQLQAA

SEQ ID NO: 3488 - protein, 9 aa, Artificial Sequence
  Description of Artificial Sequence:  Synthetic Peptide
CVVVSSNGL

SEQ ID NO: 3489 - protein, 9 aa, Artificial Sequence
  Description of Artificial Sequence:  Synthetic Peptide
HLMAQDAML

SEQ ID NO: 3490 - protein, 9 aa, Artificial Sequence
  Description of Artificial Sequence:  Synthetic Peptide
TPPTYILIL

SEQ ID NO: 3491 - protein, 9 aa, Artificial Sequence
  Description of Artificial Sequence:  Synthetic Peptide
RPVDKAGRV

SEQ ID NO: 3492 - protein, 9 aa, Artificial Sequence
  Description of Artificial Sequence:  Synthetic Peptide
DAMLDPTPY

SEQ ID NO: 3493 - protein, 10 aa, Artificial Sequence
  Description of Artificial Sequence:  Synthetic Peptide
SLCSTPPTYI

SEQ ID NO: 3494 - protein, 10 aa, Artificial Sequence
  Description of Artificial Sequence:  Synthetic Peptide
MLDPTPYKYC

SEQ ID NO: 3495 - protein, 10 aa, Artificial Sequence
  Description of Artificial Sequence:  Synthetic Peptide
RVQLQAASSL

SEQ ID NO: 3496 - protein, 10 aa, Artificial Sequence
  Description of Artificial Sequence:  Synthetic Peptide
RSQRSPRVQL

SEQ ID NO: 3497 - protein, 10 aa, Artificial Sequence
  Description of Artificial Sequence:  Synthetic Peptide
KYCTSTMFWW

SEQ ID NO: 3498 - protein, 10 aa, Artificial Sequence
  Description of Artificial Sequence:  Synthetic Peptide
PYKYCTSTMF

SEQ ID NO: 3499 - protein, 10 aa, Artificial Sequence
  Description of Artificial Sequence:  Synthetic Peptide
AMLDPTPYKY

SEQ ID NO: 3500 - protein, 10 aa, Artificial Sequence
  Description of Artificial Sequence:  Synthetic Peptide
RNRRTTYSHL

SEQ ID NO: 3501 - protein, 10 aa, Artificial Sequence
  Description of Artificial Sequence:  Synthetic Peptide
RVQLQAASSL

SEQ ID NO: 3502 - protein, 10 aa, Artificial Sequence
  Description of Artificial Sequence:  Synthetic Peptide
TPYKYCTSTM

SEQ ID NO: 3503 - protein, 10 aa, Artificial Sequence
  Description of Artificial Sequence:  Synthetic Peptide
SSRSQRSPRV

SEQ ID NO: 3504 - protein, 10 aa, Artificial Sequence
  Description of Artificial Sequence:  Synthetic Peptide
TPYKYCTSTM

SEQ ID NO: 3505 - protein, 10 aa, Artificial Sequence
  Description of Artificial Sequence:  Synthetic Peptide
ASRRNRRTTY

SEQ ID NO: 3506 - protein, 10 aa, Artificial Sequence
  Description of Artificial Sequence:  Synthetic Peptide
RPVDKAGRVV

SEQ ID NO: 3507 - protein, 10 aa, Artificial Sequence
  Description of Artificial Sequence:  Synthetic Peptide
RSQRSPRVQL

SEQ ID NO: 3508 - protein, 10 aa, Artificial Sequence
  Description of Artificial Sequence:  Synthetic Peptide
SSLCSTPPTY

SEQ ID NO: 3509 - protein, 10 aa, Artificial Sequence
  Description of Artificial Sequence:  Synthetic Peptide
YSHLMAQDAM

SEQ ID NO: 3510 - protein, 10 aa, Artificial Sequence
  Description of Artificial Sequence:  Synthetic Peptide
TSTMFWWRWM

SEQ ID NO: 3511 - protein, 10 aa, Artificial Sequence
  Description of Artificial Sequence:  Synthetic Peptide
QDAMLDPTPY

SEQ ID NO: 3512 - protein, 10 aa, Artificial Sequence
  Description of Artificial Sequence:  Synthetic Peptide
SSLCSTPPTY

SEQ ID NO: 3513 - protein, 9 aa, Artificial Sequence
  Description of Artificial Sequence:  Synthetic Peptide
VLLRTKTSV

SEQ ID NO: 3514 - protein, 9 aa, Artificial Sequence
  Description of Artificial Sequence:  Synthetic Peptide
TLVNPVEFI

SEQ ID NO: 3515 - protein, 9 aa, Artificial Sequence
  Description of Artificial Sequence:  Synthetic Peptide
FIQVQPNQL

SEQ ID NO: 3516 - protein, 9 aa, Artificial Sequence
  Description of Artificial Sequence:  Synthetic Peptide
LPSGGLVLL

SEQ ID NO: 3517 - protein, 9 aa, Artificial Sequence
  Description of Artificial Sequence:  Synthetic Peptide
APHTLVNPV

SEQ ID NO: 3518 - protein, 9 aa, Artificial Sequence
  Description of Artificial Sequence:  Synthetic Peptide
LPSGGLVLL

SEQ ID NO: 3519 - protein, 10 aa, Artificial Sequence
  Description of Artificial Sequence:  Synthetic Peptide
QLPSGGLVLL

SEQ ID NO: 3520 - protein, 10 aa, Artificial Sequence
  Description of Artificial Sequence:  Synthetic Peptide
LVLLRTKTSV

SEQ ID NO: 3521 - protein, 10 aa, Artificial Sequence
  Description of Artificial Sequence:  Synthetic Peptide
LVNPVEFIQV

SEQ ID NO: 3522 - protein, 10 aa, Artificial Sequence
  Description of Artificial Sequence:  Synthetic Peptide
EFIQVQPNQL

SEQ ID NO: 3523 - protein, 10 aa, Artificial Sequence
  Description of Artificial Sequence:  Synthetic Peptide
QPNQLPSGGL

SEQ ID NO: 3524 - protein, 10 aa, Artificial Sequence
  Description of Artificial Sequence:  Synthetic Peptide
QPNQLPSGGL

SEQ ID NO: 3525 - protein, 9 aa, Artificial Sequence
  Description of Artificial Sequence:  Synthetic Peptide
TILELGQSL

SEQ ID NO: 3526 - protein, 9 aa, Artificial Sequence
  Description of Artificial Sequence:  Synthetic Peptide
TILELGQSL

SEQ ID NO: 3527 - protein, 9 aa, Artificial Sequence
  Description of Artificial Sequence:  Synthetic Peptide
AASYTILEL

SEQ ID NO: 3528 - protein, 9 aa, Artificial Sequence
  Description of Artificial Sequence:  Synthetic Peptide
ASAASYTIL

SEQ ID NO: 3529 - protein, 9 aa, Artificial Sequence
  Description of Artificial Sequence:  Synthetic Peptide
LELGQSLVT

SEQ ID NO: 3530 - protein, 10 aa, Artificial Sequence
  Description of Artificial Sequence:  Synthetic Peptide
TILELGQSLV

SEQ ID NO: 3531 - protein, 10 aa, Artificial Sequence
  Description of Artificial Sequence:  Synthetic Peptide
MASAASYTIL

SEQ ID NO: 3532 - protein, 10 aa, Artificial Sequence
  Description of Artificial Sequence:  Synthetic Peptide
SAASYTILEL

SEQ ID NO: 3533 - protein, 10 aa, Artificial Sequence
  Description of Artificial Sequence:  Synthetic Peptide
LELGQSLVTW

SEQ ID NO: 3534 - protein, 9 aa, Artificial Sequence
  Description of Artificial Sequence:  Synthetic Peptide
HPAHPQPSL

SEQ ID NO: 3535 - protein, 9 aa, Artificial Sequence
  Description of Artificial Sequence:  Synthetic Peptide
RVSMTLPKL

SEQ ID NO: 3536 - protein, 9 aa, Artificial Sequence
  Description of Artificial Sequence:  Synthetic Peptide
HPAHPQPSL

SEQ ID NO: 3537 - protein, 10 aa, Artificial Sequence
  Description of Artificial Sequence:  Synthetic Peptide
KPHVRVSMTL

SEQ ID NO: 3538 - protein, 10 aa, Artificial Sequence
  Description of Artificial Sequence:  Synthetic Peptide
KPHVRVSMTL

SEQ ID NO: 3539 - protein, 10 aa, Artificial Sequence
  Description of Artificial Sequence:  Synthetic Peptide
EPRGDRSHPA

SEQ ID NO: 3540 - protein, 10 aa, Artificial Sequence
  Description of Artificial Sequence:  Synthetic Peptide
YPMRSAKPHV

SEQ ID NO: 3541 - protein, 10 aa, Artificial Sequence
  Description of Artificial Sequence:  Synthetic Peptide
EPRGDRSHPA

SEQ ID NO: 3542 - protein, 10 aa, Artificial Sequence
  Description of Artificial Sequence:  Synthetic Peptide
KLRDLRRGSV

SEQ ID NO: 3543 - protein, 10 aa, Artificial Sequence
  Description of Artificial Sequence:  Synthetic Peptide
KPHVRVSMTL

SEQ ID NO: 3544 - protein, 10 aa, Artificial Sequence
  Description of Artificial Sequence:  Synthetic Peptide
SAKPHVRVSM

SEQ ID NO: 3545 - protein, 9 aa, Artificial Sequence
  Description of Artificial Sequence:  Synthetic Peptide
PYQAVPQGL

SEQ ID NO: 3546 - protein, 9 aa, Artificial Sequence
  Description of Artificial Sequence:  Synthetic Peptide
GLSRPNTTR

SEQ ID NO: 3547 - protein, 9 aa, Artificial Sequence
  Description of Artificial Sequence:  Synthetic Peptide
LSRPNTTRL

SEQ ID NO: 3548 - protein, 9 aa, Artificial Sequence
  Description of Artificial Sequence:  Synthetic Peptide
LPGHSQAPY

SEQ ID NO: 3549 - protein, 9 aa, Artificial Sequence
  Description of Artificial Sequence:  Synthetic Peptide
LSRPNTTRL

SEQ ID NO: 3550 - protein, 10 aa, Artificial Sequence
  Description of Artificial Sequence:  Synthetic Peptide
GLSRPNTTRL

SEQ ID NO: 3551 - protein, 10 aa, Artificial Sequence
  Description of Artificial Sequence:  Synthetic Peptide
RPNTTRLAVL

SEQ ID NO: 3552 - protein, 10 aa, Artificial Sequence
  Description of Artificial Sequence:  Synthetic Peptide
VLRGHAQISR

SEQ ID NO: 3553 - protein, 10 aa, Artificial Sequence
  Description of Artificial Sequence:  Synthetic Peptide
APYQAVPQGL

SEQ ID NO: 3554 - protein, 10 aa, Artificial Sequence
  Description of Artificial Sequence:  Synthetic Peptide
RPNTTRLAVL

SEQ ID NO: 3555 - protein, 10 aa, Artificial Sequence
  Description of Artificial Sequence:  Synthetic Peptide
RPNTTRLAVL

SEQ ID NO: 3556 - protein, 10 aa, Artificial Sequence
  Description of Artificial Sequence:  Synthetic Peptide
APYQAVPQGL

SEQ ID NO: 3557 - protein, 9 aa, Artificial Sequence
  Description of Artificial Sequence:  Synthetic Peptide
REASISTLC

SEQ ID NO: 3558 - protein, 10 aa, Artificial Sequence
  Description of Artificial Sequence:  Synthetic Peptide
ICREASISTL

SEQ ID NO: 3559 - protein, 10 aa, Artificial Sequence
  Description of Artificial Sequence:  Synthetic Peptide
ICREASISTL

SEQ ID NO: 3560 - protein, 10 aa, Artificial Sequence
  Description of Artificial Sequence:  Synthetic Peptide
REASISTLCS

SEQ ID NO: 3561 - protein, 9 aa, Artificial Sequence
  Description of Artificial Sequence:  Synthetic Peptide
WSEFELCSY

SEQ ID NO: 3562 - protein, 9 aa, Artificial Sequence
  Description of Artificial Sequence:  Synthetic Peptide
FELCSYCPV

SEQ ID NO: 3563 - protein, 9 aa, Artificial Sequence
  Description of Artificial Sequence:  Synthetic Peptide
SYCPVEEVL

SEQ ID NO: 3564 - protein, 9 aa, Artificial Sequence
  Description of Artificial Sequence:  Synthetic Peptide
RYPKFSEAC

SEQ ID NO: 3565 - protein, 9 aa, Artificial Sequence
  Description of Artificial Sequence:  Synthetic Peptide
RYWSEFELC

SEQ ID NO: 3566 - protein, 9 aa, Artificial Sequence
  Description of Artificial Sequence:  Synthetic Peptide
VSPSSQGRY

SEQ ID NO: 3567 - protein, 9 aa, Artificial Sequence
  Description of Artificial Sequence:  Synthetic Peptide
EEVLATYGS

SEQ ID NO: 3568 - protein, 10 aa, Artificial Sequence
  Description of Artificial Sequence:  Synthetic Peptide
KFSEACGHPI

SEQ ID NO: 3569 - protein, 10 aa, Artificial Sequence
  Description of Artificial Sequence:  Synthetic Peptide
RYWSEFELCS

SEQ ID NO: 3570 - protein, 10 aa, Artificial Sequence
  Description of Artificial Sequence:  Synthetic Peptide
SGRYWSEFEL

SEQ ID NO: 3571 - protein, 10 aa, Artificial Sequence
  Description of Artificial Sequence:  Synthetic Peptide
CPVEEVLATY

SEQ ID NO: 3572 - protein, 10 aa, Artificial Sequence
  Description of Artificial Sequence:  Synthetic Peptide
SEACGHPIDF

SEQ ID NO: 3573 - protein, 10 aa, Artificial Sequence
  Description of Artificial Sequence:  Synthetic Peptide
CPVEEVLATY

SEQ ID NO: 3574 - protein, 10 aa, Artificial Sequence
  Description of Artificial Sequence:  Synthetic Peptide
REPAGQVQLA

SEQ ID NO: 3575 - protein, 10 aa, Artificial Sequence
  Description of Artificial Sequence:  Synthetic Peptide
ADAPGPVSPS

SEQ ID NO: 3576 - protein, 10 aa, Artificial Sequence
  Description of Artificial Sequence:  Synthetic Peptide
RPQCGGKHDY

SEQ ID NO: 3577 - protein, 9 aa, Artificial Sequence
  Description of Artificial Sequence:  Synthetic Peptide
DVFCPITKL

SEQ ID NO: 3578 - protein, 10 aa, Artificial Sequence
  Description of Artificial Sequence:  Synthetic Peptide
ATDVFCPITK

SEQ ID NO: 3579 - protein, 10 aa, Artificial Sequence
  Description of Artificial Sequence:  Synthetic Peptide
VFCPITKLGF

SEQ ID NO: 3580 - protein, 9 aa, Artificial Sequence
  Description of Artificial Sequence:  Synthetic Peptide
FLLPLASTA

SEQ ID NO: 3581 - protein, 10 aa, Artificial Sequence
  Description of Artificial Sequence:  Synthetic Peptide
NLQSVKCDFL

SEQ ID NO: 3582 - protein, 10 aa, Artificial Sequence
  Description of Artificial Sequence:  Synthetic Peptide
LQSVKCDFLL

SEQ ID NO: 3583 - protein, 10 aa, Artificial Sequence
  Description of Artificial Sequence:  Synthetic Peptide
SVKCDFLLPL

SEQ ID NO: 3584 - protein, 9 aa, Artificial Sequence
  Description of Artificial Sequence:  Synthetic Peptide
FVVGLFPRL

SEQ ID NO: 3585 - protein, 9 aa, Artificial Sequence
  Description of Artificial Sequence:  Synthetic Peptide
FVVGLFPRL

SEQ ID NO: 3586 - protein, 10 aa, Artificial Sequence
  Description of Artificial Sequence:  Synthetic Peptide
WFVVGLFPRL

SEQ ID NO: 3587 - protein, 10 aa, Artificial Sequence
  Description of Artificial Sequence:  Synthetic Peptide
RQHGHVRFGL

SEQ ID NO: 3588 - protein, 10 aa, Artificial Sequence
  Description of Artificial Sequence:  Synthetic Peptide
RQHGHVRFGL

SEQ ID NO: 3589 - protein, 10 aa, Artificial Sequence
  Description of Artificial Sequence:  Synthetic Peptide
SEHGRQHGHV

SEQ ID NO: 3590 - protein, 9 aa, Artificial Sequence
  Description of Artificial Sequence:  Synthetic Peptide
DPRQLWHEL

SEQ ID NO: 3591 - protein, 9 aa, Artificial Sequence
  Description of Artificial Sequence:  Synthetic Peptide
SPDPLIPAL

SEQ ID NO: 3592 - protein, 9 aa, Artificial Sequence
  Description of Artificial Sequence:  Synthetic Peptide
DAVPSPDPL

SEQ ID NO: 3593 - protein, 9 aa, Artificial Sequence
  Description of Artificial Sequence:  Synthetic Peptide
DPRQLWHEL

SEQ ID NO: 3594 - protein, 9 aa, Artificial Sequence
  Description of Artificial Sequence:  Synthetic Peptide
DPRQLWHEL

SEQ ID NO: 3595 - protein, 10 aa, Artificial Sequence
  Description of Artificial Sequence:  Synthetic Peptide
AGHKGDPRQL

SEQ ID NO: 3596 - protein, 10 aa, Artificial Sequence
  Description of Artificial Sequence:  Synthetic Peptide
QPVHPLHCPL

SEQ ID NO: 3597 - protein, 10 aa, Artificial Sequence
  Description of Artificial Sequence:  Synthetic Peptide
QPVHPLHCPL

SEQ ID NO: 3598 - protein, 10 aa, Artificial Sequence
  Description of Artificial Sequence:  Synthetic Peptide
LARANVPAQY

SEQ ID NO: 3599 - protein, 10 aa, Artificial Sequence
  Description of Artificial Sequence:  Synthetic Peptide
GEGYQPVHPL

SEQ ID NO: 3600 - protein, 9 aa, Artificial Sequence
  Description of Artificial Sequence:  Synthetic Peptide
LLGEHHPLL

SEQ ID NO: 3601 - protein, 9 aa, Artificial Sequence
  Description of Artificial Sequence:  Synthetic Peptide
GLQEAEGLL

SEQ ID NO: 3602 - protein, 9 aa, Artificial Sequence
  Description of Artificial Sequence:  Synthetic Peptide
RGLQEAEGL

SEQ ID NO: 3603 - protein, 9 aa, Artificial Sequence
  Description of Artificial Sequence:  Synthetic Peptide
DSRGDNLCL

SEQ ID NO: 3604 - protein, 9 aa, Artificial Sequence
  Description of Artificial Sequence:  Synthetic Peptide
DSRGDNLCL

SEQ ID NO: 3605 - protein, 9 aa, Artificial Sequence
  Description of Artificial Sequence:  Synthetic Peptide
AEGLLLELL

SEQ ID NO: 3606 - protein, 10 aa, Artificial Sequence
  Description of Artificial Sequence:  Synthetic Peptide
GLQEAEGLLL

SEQ ID NO: 3607 - protein, 10 aa, Artificial Sequence
  Description of Artificial Sequence:  Synthetic Peptide
MLRPEGLEFL

SEQ ID NO: 3608 - protein, 10 aa, Artificial Sequence
  Description of Artificial Sequence:  Synthetic Peptide
CLTGRGLQEA

SEQ ID NO: 3609 - protein, 10 aa, Artificial Sequence
  Description of Artificial Sequence:  Synthetic Peptide
RGLQEAEGLL

SEQ ID NO: 3610 - protein, 10 aa, Artificial Sequence
  Description of Artificial Sequence:  Synthetic Peptide
MLRPEGLEFL

SEQ ID NO: 3611 - protein, 10 aa, Artificial Sequence
  Description of Artificial Sequence:  Synthetic Peptide
QEAEGLLLEL

SEQ ID NO: 3612 - protein, 9 aa, Artificial Sequence
  Description of Artificial Sequence:  Synthetic Peptide
KVLPTLLCL

SEQ ID NO: 3613 - protein, 9 aa, Artificial Sequence
  Description of Artificial Sequence:  Synthetic Peptide
KVLPTLLCL

SEQ ID NO: 3614 - protein, 9 aa, Artificial Sequence
  Description of Artificial Sequence:  Synthetic Peptide
GLVRYQVRK

SEQ ID NO: 3615 - protein, 9 aa, Artificial Sequence
  Description of Artificial Sequence:  Synthetic Peptide
QVRKVLPTL

SEQ ID NO: 3616 - protein, 9 aa, Artificial Sequence
  Description of Artificial Sequence:  Synthetic Peptide
LVPRWGRGL

SEQ ID NO: 3617 - protein, 9 aa, Artificial Sequence
  Description of Artificial Sequence:  Synthetic Peptide
KVLPTLLCL

SEQ ID NO: 3618 - protein, 9 aa, Artificial Sequence
  Description of Artificial Sequence:  Synthetic Peptide
EANQTLPHL

SEQ ID NO: 3619 - protein, 9 aa, Artificial Sequence
  Description of Artificial Sequence:  Synthetic Peptide
LVRYQVRKV

SEQ ID NO: 3620 - protein, 9 aa, Artificial Sequence
  Description of Artificial Sequence:  Synthetic Peptide
SAHGGLVRY

SEQ ID NO: 3621 - protein, 10 aa, Artificial Sequence
  Description of Artificial Sequence:  Synthetic Peptide
GLVRYQVRKV

SEQ ID NO: 3622 - protein, 10 aa, Artificial Sequence
  Description of Artificial Sequence:  Synthetic Peptide
YQVRKVLPTL

SEQ ID NO: 3623 - protein, 10 aa, Artificial Sequence
  Description of Artificial Sequence:  Synthetic Peptide
RYQVRKVLPT

SEQ ID NO: 3624 - protein, 10 aa, Artificial Sequence
  Description of Artificial Sequence:  Synthetic Peptide
LVRYQVRKVL

SEQ ID NO: 3625 - protein, 10 aa, Artificial Sequence
  Description of Artificial Sequence:  Synthetic Peptide
QVRKVLPTLL

SEQ ID NO: 3626 - protein, 10 aa, Artificial Sequence
  Description of Artificial Sequence:  Synthetic Peptide
LEANQTLPHL

SEQ ID NO: 3627 - protein, 10 aa, Artificial Sequence
  Description of Artificial Sequence:  Synthetic Peptide
EDEMSPPLDY

SEQ ID NO: 3628 - protein, 10 aa, Artificial Sequence
  Description of Artificial Sequence:  Synthetic Peptide
GVALVTNYYV

SEQ ID NO: 3629 - protein, 10 aa, Artificial Sequence
  Description of Artificial Sequence:  Synthetic Peptide
VISAPRAPAV

SEQ ID NO: 3630 - protein, 10 aa, Artificial Sequence
  Description of Artificial Sequence:  Synthetic Peptide
GMGHSDGARR

SEQ ID NO: 3631 - protein, 10 aa, Artificial Sequence
  Description of Artificial Sequence:  Synthetic Peptide
APAVGKELAV

SEQ ID NO: 3632 - protein, 10 aa, Artificial Sequence
  Description of Artificial Sequence:  Synthetic Peptide
DEMSPPLDYF

SEQ ID NO: 3633 - protein, 10 aa, Artificial Sequence
  Description of Artificial Sequence:  Synthetic Peptide
EDEMSPPLDY

SEQ ID NO: 3634 - protein, 10 aa, Artificial Sequence
  Description of Artificial Sequence:  Synthetic Peptide
RGVALVTNYY

SEQ ID NO: 3635 - protein, 9 aa, Artificial Sequence
  Description of Artificial Sequence:  Synthetic Peptide
RIDPMSLGH

SEQ ID NO: 3636 - protein, 9 aa, Artificial Sequence
  Description of Artificial Sequence:  Synthetic Peptide
VALVTNYYV

SEQ ID NO: 3637 - protein, 9 aa, Artificial Sequence
  Description of Artificial Sequence:  Synthetic Peptide
RAPAVGKEL

SEQ ID NO: 3638 - protein, 9 aa, Artificial Sequence
  Description of Artificial Sequence:  Synthetic Peptide
DVRIDPMSL

SEQ ID NO: 3639 - protein, 9 aa, Artificial Sequence
  Description of Artificial Sequence:  Synthetic Peptide
QSRPRSLCL

SEQ ID NO: 3640 - protein, 9 aa, Artificial Sequence
  Description of Artificial Sequence:  Synthetic Peptide
RAPAVGKEL

SEQ ID NO: 3641 - protein, 9 aa, Artificial Sequence
  Description of Artificial Sequence:  Synthetic Peptide
QSRPRSLCL

SEQ ID NO: 3642 - protein, 9 aa, Artificial Sequence
  Description of Artificial Sequence:  Synthetic Peptide
GCGIRGVAL

SEQ ID NO: 3643 - protein, 9 aa, Artificial Sequence
  Description of Artificial Sequence:  Synthetic Peptide
QSRPRSLCL

SEQ ID NO: 3644 - protein, 9 aa, Artificial Sequence
  Description of Artificial Sequence:  Synthetic Peptide
GPDVRIDPM

SEQ ID NO: 3645 - protein, 9 aa, Artificial Sequence
  Description of Artificial Sequence:  Synthetic Peptide
QSNLLDVGM

SEQ ID NO: 3646 - protein, 9 aa, Artificial Sequence
  Description of Artificial Sequence:  Synthetic Peptide
DEMSPPLDY

SEQ ID NO: 3647 - protein, 9 aa, Artificial Sequence
  Description of Artificial Sequence:  Synthetic Peptide
RGVALVTNY

SEQ ID NO: 3648 - protein, 9 aa, Artificial Sequence
  Description of Artificial Sequence:  Synthetic Peptide
LEALGHYWW

SEQ ID NO: 3649 - protein, 9 aa, Artificial Sequence
  Description of Artificial Sequence:  Synthetic Peptide
MEVSHLEAL

SEQ ID NO: 3650 - protein, 10 aa, Artificial Sequence
  Description of Artificial Sequence:  Synthetic Peptide
ALGHYWWRGV

SEQ ID NO: 3651 - protein, 10 aa, Artificial Sequence
  Description of Artificial Sequence:  Synthetic Peptide
VSHLEALGHY

SEQ ID NO: 3652 - protein, 9 aa, Artificial Sequence
  Description of Artificial Sequence:  Synthetic Peptide
MLAEAISGA

SEQ ID NO: 3653 - protein, 9 aa, Artificial Sequence
  Description of Artificial Sequence:  Synthetic Peptide
AISGAVQGV

SEQ ID NO: 3654 - protein, 9 aa, Artificial Sequence
  Description of Artificial Sequence:  Synthetic Peptide
APRVCGVRM

SEQ ID NO: 3655 - protein, 9 aa, Artificial Sequence
  Description of Artificial Sequence:  Synthetic Peptide
GVRMLAEAI

SEQ ID NO: 3656 - protein, 9 aa, Artificial Sequence
  Description of Artificial Sequence:  Synthetic Peptide
APRVCGVRM

SEQ ID NO: 3657 - protein, 10 aa, Artificial Sequence
  Description of Artificial Sequence:  Synthetic Peptide
MLAEAISGAV

SEQ ID NO: 3658 - protein, 10 aa, Artificial Sequence
  Description of Artificial Sequence:  Synthetic Peptide
RMLAEAISGA

SEQ ID NO: 3659 - protein, 10 aa, Artificial Sequence
  Description of Artificial Sequence:  Synthetic Peptide
APRVCGVRML

SEQ ID NO: 3660 - protein, 10 aa, Artificial Sequence
  Description of Artificial Sequence:  Synthetic Peptide
APRVCGVRML

SEQ ID NO: 3661 - protein, 10 aa, Artificial Sequence
  Description of Artificial Sequence:  Synthetic Peptide
APRVCGVRML

SEQ ID NO: 3662 - protein, 10 aa, Artificial Sequence
  Description of Artificial Sequence:  Synthetic Peptide
DDTRRRSAHF

SEQ ID NO: 3663 - protein, 9 aa, Artificial Sequence
  Description of Artificial Sequence:  Synthetic Peptide
RTTAPTQVL

SEQ ID NO: 3664 - protein, 9 aa, Artificial Sequence
  Description of Artificial Sequence:  Synthetic Peptide
RYKIAIAQS

SEQ ID NO: 3665 - protein, 10 aa, Artificial Sequence
  Description of Artificial Sequence:  Synthetic Peptide
RYKIAIAQSI

SEQ ID NO: 3666 - protein, 10 aa, Artificial Sequence
  Description of Artificial Sequence:  Synthetic Peptide
TYQVTAWLGI

SEQ ID NO: 3667 - protein, 9 aa, Artificial Sequence
  Description of Artificial Sequence:  Synthetic Peptide
SFLPMVVAL

SEQ ID NO: 3668 - protein, 9 aa, Artificial Sequence
  Description of Artificial Sequence:  Synthetic Peptide
SYQLSETSL

SEQ ID NO: 3669 - protein, 9 aa, Artificial Sequence
  Description of Artificial Sequence:  Synthetic Peptide
RGLSCSPPL

SEQ ID NO: 3670 - protein, 9 aa, Artificial Sequence
  Description of Artificial Sequence:  Synthetic Peptide
KQPPNKRRL

SEQ ID NO: 3671 - protein, 10 aa, Artificial Sequence
  Description of Artificial Sequence:  Synthetic Peptide
KQPPNKRRLL

SEQ ID NO: 3672 - protein, 9 aa, Artificial Sequence
  Description of Artificial Sequence:  Synthetic Peptide
RSSPALPSL

SEQ ID NO: 3673 - protein, 9 aa, Artificial Sequence
  Description of Artificial Sequence:  Synthetic Peptide
RATPQRVLL

SEQ ID NO: 3674 - protein, 10 aa, Artificial Sequence
  Description of Artificial Sequence:  Synthetic Peptide
RVLLRSSPAL

SEQ ID NO: 3675 - protein, 9 aa, Artificial Sequence
  Description of Artificial Sequence:  Synthetic Peptide
KYPFRRRSC

SEQ ID NO: 3676 - protein, 9 aa, Artificial Sequence
  Description of Artificial Sequence:  Synthetic Peptide
VYARRWPSM

SEQ ID NO: 3677 - protein, 10 aa, Artificial Sequence
  Description of Artificial Sequence:  Synthetic Peptide
VYARRWPSMM

SEQ ID NO: 3678 - protein, 9 aa, Artificial Sequence
  Description of Artificial Sequence:  Synthetic Peptide
RSPRTTSVL

SEQ ID NO: 3679 - protein, 10 aa, Artificial Sequence
  Description of Artificial Sequence:  Synthetic Peptide
GYHPCESGDI

SEQ ID NO: 3680 - protein, 9 aa, Artificial Sequence
  Description of Artificial Sequence:  Synthetic Peptide
LFDHPSFRL

SEQ ID NO: 3681 - protein, 9 aa, Artificial Sequence
  Description of Artificial Sequence:  Synthetic Peptide
LFLYLPLSF

SEQ ID NO: 3682 - protein, 9 aa, Artificial Sequence
  Description of Artificial Sequence:  Synthetic Peptide
RLLFLYLPL

SEQ ID NO: 3683 - protein, 9 aa, Artificial Sequence
  Description of Artificial Sequence:  Synthetic Peptide
LYLPLSFAV

SEQ ID NO: 3684 - protein, 10 aa, Artificial Sequence
  Description of Artificial Sequence:  Synthetic Peptide
LYLPLSFAVL

SEQ ID NO: 3685 - protein, 10 aa, Artificial Sequence
  Description of Artificial Sequence:  Synthetic Peptide
GFCRSGTLDL

SEQ ID NO: 3686 - protein, 9 aa, Artificial Sequence
  Description of Artificial Sequence:  Synthetic Peptide
FYHQGRGAL

SEQ ID NO: 3687 - protein, 10 aa, Artificial Sequence
  Description of Artificial Sequence:  Synthetic Peptide
IFYHQGRGAL

SEQ ID NO: 3688 - protein, 9 aa, Artificial Sequence
  Description of Artificial Sequence:  Synthetic Peptide
TYAARANTL

SEQ ID NO: 3689 - protein, 9 aa, Artificial Sequence
  Description of Artificial Sequence:  Synthetic Peptide
RCIRQKGVL

SEQ ID NO: 3690 - protein, 9 aa, Artificial Sequence
  Description of Artificial Sequence:  Synthetic Peptide
RLWPERMAF

SEQ ID NO: 3691 - protein, 9 aa, Artificial Sequence
  Description of Artificial Sequence:  Synthetic Peptide
HMLSMAYGR

SEQ ID NO: 3692 - protein, 9 aa, Artificial Sequence
  Description of Artificial Sequence:  Synthetic Peptide
SMAKPSPLK

SEQ ID NO: 3693 - protein, 9 aa, Artificial Sequence
  Description of Artificial Sequence:  Synthetic Peptide
GLSCSPPLR

SEQ ID NO: 3694 - protein, 10 aa, Artificial Sequence
  Description of Artificial Sequence:  Synthetic Peptide
ILERSPSMAK

SEQ ID NO: 3695 - protein, 9 aa, Artificial Sequence
  Description of Artificial Sequence:  Synthetic Peptide
MMWSPPFLR

SEQ ID NO: 3696 - protein, 9 aa, Artificial Sequence
  Description of Artificial Sequence:  Synthetic Peptide
QIWESVYAR

SEQ ID NO: 3697 - protein, 10 aa, Artificial Sequence
  Description of Artificial Sequence:  Synthetic Peptide
SMMWSPPFLR

SEQ ID NO: 3698 - protein, 9 aa, Artificial Sequence
  Description of Artificial Sequence:  Synthetic Peptide
VLFDHPSFR

SEQ ID NO: 3699 - protein, 10 aa, Artificial Sequence
  Description of Artificial Sequence:  Synthetic Peptide
LLFLYLPLSF

SEQ ID NO: 3700 - protein, 10 aa, Artificial Sequence
  Description of Artificial Sequence:  Synthetic Peptide
VLFDHPSFRL

SEQ ID NO: 3701 - protein, 9 aa, Artificial Sequence
  Description of Artificial Sequence:  Synthetic Peptide
GLGPRGPTR

SEQ ID NO: 3702 - protein, 10 aa, Artificial Sequence
  Description of Artificial Sequence:  Synthetic Peptide
GLHEAGRADR

SEQ ID NO: 3703 - protein, 9 aa, Artificial Sequence
  Description of Artificial Sequence:  Synthetic Peptide
GLHDARERR

SEQ ID NO: 3704 - protein, 10 aa, Artificial Sequence
  Description of Artificial Sequence:  Synthetic Peptide
VIWVRSSIPL

SEQ ID NO: 3705 - protein, 10 aa, Artificial Sequence
  Description of Artificial Sequence:  Synthetic Peptide
LVGAPQTPGV

SEQ ID NO: 3706 - protein, 9 aa, Artificial Sequence
  Description of Artificial Sequence:  Synthetic Peptide
LLWWGRPTV

SEQ ID NO: 3707 - protein, 9 aa, Artificial Sequence
  Description of Artificial Sequence:  Synthetic Peptide
VLYPRRRCV

SEQ ID NO: 3708 - protein, 9 aa, Artificial Sequence
  Description of Artificial Sequence:  Synthetic Peptide
SLLRCSTHT

SEQ ID NO: 3709 - protein, 10 aa, Artificial Sequence
  Description of Artificial Sequence:  Synthetic Peptide
VLLWWGRPTV

SEQ ID NO: 3710 - protein, 10 aa, Artificial Sequence
  Description of Artificial Sequence:  Synthetic Peptide
KLGSLLRCST

SEQ ID NO: 3711 - protein, 10 aa, Artificial Sequence
  Description of Artificial Sequence:  Synthetic Peptide
VLYPRRRCVA

SEQ ID NO: 3712 - protein, 9 aa, Artificial Sequence
  Description of Artificial Sequence:  Synthetic Peptide
FSWRTRASV

SEQ ID NO: 3713 - protein, 9 aa, Artificial Sequence
  Description of Artificial Sequence:  Synthetic Peptide
LMPWTERWL

SEQ ID NO: 3714 - protein, 9 aa, Artificial Sequence
  Description of Artificial Sequence:  Synthetic Peptide
SLGRHMLSM

SEQ ID NO: 3715 - protein, 10 aa, Artificial Sequence
  Description of Artificial Sequence:  Synthetic Peptide
WLHRAEARFL

SEQ ID NO: 3716 - protein, 10 aa, Artificial Sequence
  Description of Artificial Sequence:  Synthetic Peptide
SLGRHMLSMA

SEQ ID NO: 3717 - protein, 10 aa, Artificial Sequence
  Description of Artificial Sequence:  Synthetic Peptide
FLPMVVALGA

SEQ ID NO: 3718 - protein, 9 aa, Artificial Sequence
  Description of Artificial Sequence:  Synthetic Peptide
QLTRLQSWA

SEQ ID NO: 3719 - protein, 9 aa, Artificial Sequence
  Description of Artificial Sequence:  Synthetic Peptide
LILERSPSM

SEQ ID NO: 3720 - protein, 10 aa, Artificial Sequence
  Description of Artificial Sequence:  Synthetic Peptide
GLSCSPPLRL

SEQ ID NO: 3721 - protein, 10 aa, Artificial Sequence
  Description of Artificial Sequence:  Synthetic Peptide
LILERSPSMA

SEQ ID NO: 3722 - protein, 10 aa, Artificial Sequence
  Description of Artificial Sequence:  Synthetic Peptide
IQLTRLQSWA

SEQ ID NO: 3723 - protein, 10 aa, Artificial Sequence
  Description of Artificial Sequence:  Synthetic Peptide
SGGEGISFSV

SEQ ID NO: 3724 - protein, 10 aa, Artificial Sequence
  Description of Artificial Sequence:  Synthetic Peptide
QASESTLWRI

SEQ ID NO: 3725 - protein, 10 aa, Artificial Sequence
  Description of Artificial Sequence:  Synthetic Peptide
QEWPARSWPL

SEQ ID NO: 3726 - protein, 9 aa, Artificial Sequence
  Description of Artificial Sequence:  Synthetic Peptide
VLLRSSPAL

SEQ ID NO: 3727 - protein, 10 aa, Artificial Sequence
  Description of Artificial Sequence:  Synthetic Peptide
ILGRCGGWPL

SEQ ID NO: 3728 - protein, 9 aa, Artificial Sequence
  Description of Artificial Sequence:  Synthetic Peptide
SMMWSPPFL

SEQ ID NO: 3729 - protein, 9 aa, Artificial Sequence
  Description of Artificial Sequence:  Synthetic Peptide
VLRSQFTNV

SEQ ID NO: 3730 - protein, 9 aa, Artificial Sequence
  Description of Artificial Sequence:  Synthetic Peptide
KQLDTLQLT

SEQ ID NO: 3731 - protein, 9 aa, Artificial Sequence
  Description of Artificial Sequence:  Synthetic Peptide
ALAHFHSIV

SEQ ID NO: 3732 - protein, 10 aa, Artificial Sequence
  Description of Artificial Sequence:  Synthetic Peptide
TLQVRSIGWL

SEQ ID NO: 3733 - protein, 9 aa, Artificial Sequence
  Description of Artificial Sequence:  Synthetic Peptide
FLYLPLSFA

SEQ ID NO: 3734 - protein, 9 aa, Artificial Sequence
  Description of Artificial Sequence:  Synthetic Peptide
RLLQLKYCV

SEQ ID NO: 3735 - protein, 9 aa, Artificial Sequence
  Description of Artificial Sequence:  Synthetic Peptide
RLLFLYLPL

SEQ ID NO: 3736 - protein, 9 aa, Artificial Sequence
  Description of Artificial Sequence:  Synthetic Peptide
YLPLSFAVL

SEQ ID NO: 3737 - protein, 10 aa, Artificial Sequence
  Description of Artificial Sequence:  Synthetic Peptide
FLYLPLSFAV

SEQ ID NO: 3738 - protein, 10 aa, Artificial Sequence
  Description of Artificial Sequence:  Synthetic Peptide
VLFDHPSFRL

SEQ ID NO: 3739 - protein, 10 aa, Artificial Sequence
  Description of Artificial Sequence:  Synthetic Peptide
ALAGFTTTSL

SEQ ID NO: 3740 - protein, 10 aa, Artificial Sequence
  Description of Artificial Sequence:  Synthetic Peptide
SLCPNGLHEA

SEQ ID NO: 3741 - protein, 9 aa, Artificial Sequence
  Description of Artificial Sequence:  Synthetic Peptide
LIPPGRTAV

SEQ ID NO: 3742 - protein, 10 aa, Artificial Sequence
  Description of Artificial Sequence:  Synthetic Peptide
QLIPPGRTAV

SEQ ID NO: 3743 - protein, 9 aa, Artificial Sequence
  Description of Artificial Sequence:  Synthetic Peptide
MLLEGLCSL

SEQ ID NO: 3744 - protein, 10 aa, Artificial Sequence
  Description of Artificial Sequence:  Synthetic Peptide
SLSSCEAPGL

SEQ ID NO: 3745 - protein, 10 aa, Artificial Sequence
  Description of Artificial Sequence:  Synthetic Peptide
FLQCVGRPRC

SEQ ID NO: 3746 - protein, 10 aa, Artificial Sequence
  Description of Artificial Sequence:  Synthetic Peptide
SGEPLRHSGR

SEQ ID NO: 3747 - protein, 9 aa, Artificial Sequence
  Description of Artificial Sequence:  Synthetic Peptide
STDHRTCQK

SEQ ID NO: 3748 - protein, 10 aa, Artificial Sequence
  Description of Artificial Sequence:  Synthetic Peptide
STDHRTCQKR

SEQ ID NO: 3749 - protein, 9 aa, Artificial Sequence
  Description of Artificial Sequence:  Synthetic Peptide
TPGVGRVIW

SEQ ID NO: 3750 - protein, 10 aa, Artificial Sequence
  Description of Artificial Sequence:  Synthetic Peptide
IPATYQVTAW

SEQ ID NO: 3751 - protein, 9 aa, Artificial Sequence
  Description of Artificial Sequence:  Synthetic Peptide
SPRIAGGRM

SEQ ID NO: 3752 - protein, 9 aa, Artificial Sequence
  Description of Artificial Sequence:  Synthetic Peptide
TPSKLGSLL

SEQ ID NO: 3753 - protein, 10 aa, Artificial Sequence
  Description of Artificial Sequence:  Synthetic Peptide
RPTVPESPRI

SEQ ID NO: 3754 - protein, 10 aa, Artificial Sequence
  Description of Artificial Sequence:  Synthetic Peptide
RTRGLIAGTM

SEQ ID NO: 3755 - protein, 10 aa, Artificial Sequence
  Description of Artificial Sequence:  Synthetic Peptide
ESPRIAGGRM

SEQ ID NO: 3756 - protein, 10 aa, Artificial Sequence
  Description of Artificial Sequence:  Synthetic Peptide
KAGWSLGRHM

SEQ ID NO: 3757 - protein, 10 aa, Artificial Sequence
  Description of Artificial Sequence:  Synthetic Peptide
WSLGRHMLSM

SEQ ID NO: 3758 - protein, 10 aa, Artificial Sequence
  Description of Artificial Sequence:  Synthetic Peptide
APPGTSKAGW

SEQ ID NO: 3759 - protein, 10 aa, Artificial Sequence
  Description of Artificial Sequence:  Synthetic Peptide
LPMVVALGAL

SEQ ID NO: 3760 - protein, 10 aa, Artificial Sequence
  Description of Artificial Sequence:  Synthetic Peptide
KPSGGEGISF

SEQ ID NO: 3761 - protein, 10 aa, Artificial Sequence
  Description of Artificial Sequence:  Synthetic Peptide
SPSMAKPSPL

SEQ ID NO: 3762 - protein, 10 aa, Artificial Sequence
  Description of Artificial Sequence:  Synthetic Peptide
TSRRWPCLIL

SEQ ID NO: 3763 - protein, 9 aa, Artificial Sequence
  Description of Artificial Sequence:  Synthetic Peptide
RPRLGCGPT

SEQ ID NO: 3764 - protein, 9 aa, Artificial Sequence
  Description of Artificial Sequence:  Synthetic Peptide
QPPNKRRLL

SEQ ID NO: 3765 - protein, 9 aa, Artificial Sequence
  Description of Artificial Sequence:  Synthetic Peptide
SSSRKRSGY

SEQ ID NO: 3766 - protein, 9 aa, Artificial Sequence
  Description of Artificial Sequence:  Synthetic Peptide
QPPNKRRLL

SEQ ID NO: 3767 - protein, 9 aa, Artificial Sequence
  Description of Artificial Sequence:  Synthetic Peptide
SSSSRKSGY

SEQ ID NO: 3768 - protein, 10 aa, Artificial Sequence
  Description of Artificial Sequence:  Synthetic Peptide
KSAPRTSLTL

SEQ ID NO: 3769 - protein, 9 aa, Artificial Sequence
  Description of Artificial Sequence:  Synthetic Peptide
RSSPALPSL

SEQ ID NO: 3770 - protein, 9 aa, Artificial Sequence
  Description of Artificial Sequence:  Synthetic Peptide
TPRAPAHPL

SEQ ID NO: 3771 - protein, 9 aa, Artificial Sequence
  Description of Artificial Sequence:  Synthetic Peptide
HPLQRQTIL

SEQ ID NO: 3772 - protein, 10 aa, Artificial Sequence
  Description of Artificial Sequence:  Synthetic Peptide
RPTSCGGRRW

SEQ ID NO: 3773 - protein, 10 aa, Artificial Sequence
  Description of Artificial Sequence:  Synthetic Peptide
SPAWSRRTRW

SEQ ID NO: 3774 - protein, 9 aa, Artificial Sequence
  Description of Artificial Sequence:  Synthetic Peptide
SPLTDCKSW

SEQ ID NO: 3775 - protein, 9 aa, Artificial Sequence
  Description of Artificial Sequence:  Synthetic Peptide
YARRWPSMM

SEQ ID NO: 3776 - protein, 9 aa, Artificial Sequence
  Description of Artificial Sequence:  Synthetic Peptide
YSQIWESVY

SEQ ID NO: 3777 - protein, 10 aa, Artificial Sequence
  Description of Artificial Sequence:  Synthetic Peptide
WSPMMWSPPF

SEQ ID NO: 3778 - protein, 10 aa, Artificial Sequence
  Description of Artificial Sequence:  Synthetic Peptide
QPALSYSQIW

SEQ ID NO: 3779 - protein, 9 aa, Artificial Sequence
  Description of Artificial Sequence:  Synthetic Peptide
RSPRTTSVL

SEQ ID NO: 3780 - protein, 9 aa, Artificial Sequence
  Description of Artificial Sequence:  Synthetic Peptide
IPPPPSHGL

SEQ ID NO: 3781 - protein, 9 aa, Artificial Sequence
  Description of Artificial Sequence:  Synthetic Peptide
CPRGGGPPL

SEQ ID NO: 3782 - protein, 9 aa, Artificial Sequence
  Description of Artificial Sequence:  Synthetic Peptide
GPGASALGY

SEQ ID NO: 3783 - protein, 10 aa, Artificial Sequence
  Description of Artificial Sequence:  Synthetic Peptide
CPRGGGPPLV

SEQ ID NO: 3784 - protein, 9 aa, Artificial Sequence
  Description of Artificial Sequence:  Synthetic Peptide
LPLSFAVLF

SEQ ID NO: 3785 - protein, 9 aa, Artificial Sequence
  Description of Artificial Sequence:  Synthetic Peptide
ESARLLFLY

SEQ ID NO: 3786 - protein, 10 aa, Artificial Sequence
  Description of Artificial Sequence:  Synthetic Peptide
RPGSGGRREL

SEQ ID NO: 3787 - protein, 10 aa, Artificial Sequence
  Description of Artificial Sequence:  Synthetic Peptide
IPCHERLLQL

SEQ ID NO: 3788 - protein, 10 aa, Artificial Sequence
  Description of Artificial Sequence:  Synthetic Peptide
SPGGRARLCL

SEQ ID NO: 3789 - protein, 10 aa, Artificial Sequence
  Description of Artificial Sequence:  Synthetic Peptide
LPSPGGRARL

SEQ ID NO: 3790 - protein, 9 aa, Artificial Sequence
  Description of Artificial Sequence:  Synthetic Peptide
QPSYPATGL

SEQ ID NO: 3791 - protein, 10 aa, Artificial Sequence
  Description of Artificial Sequence:  Synthetic Peptide
VSAEGRWGSL

SEQ ID NO: 3792 - protein, 9 aa, Artificial Sequence
  Description of Artificial Sequence:  Synthetic Peptide
RSHWQRQEY

SEQ ID NO: 3793 - protein, 9 aa, Artificial Sequence
  Description of Artificial Sequence:  Synthetic Peptide
CARRVHGNY

SEQ ID NO: 3794 - protein, 10 aa, Artificial Sequence
  Description of Artificial Sequence:  Synthetic Peptide
HPGGCEGGGL

SEQ ID NO: 3795 - protein, 10 aa, Artificial Sequence
  Description of Artificial Sequence:  Synthetic Peptide
CARRVHGNYY

SEQ ID NO: 3796 - protein, 10 aa, Artificial Sequence
  Description of Artificial Sequence:  Synthetic Peptide
RPRCIRQKGV

SEQ ID NO: 3797 - protein, 10 aa, Artificial Sequence
  Description of Artificial Sequence:  Synthetic Peptide
MPQETWGTTL

SEQ ID NO: 3798 - protein, 10 aa, Artificial Sequence
  Description of Artificial Sequence:  Synthetic Peptide
HELMPWTERW

SEQ ID NO: 3799 - protein, 10 aa, Artificial Sequence
  Description of Artificial Sequence:  Synthetic Peptide
MEQEWPARSW

SEQ ID NO: 3800 - protein, 9 aa, Artificial Sequence
  Description of Artificial Sequence:  Synthetic Peptide
WESVYARRW

SEQ ID NO: 3801 - protein, 9 aa, Artificial Sequence
  Description of Artificial Sequence:  Synthetic Peptide
HERLLQLKY

SEQ ID NO: 3802 - protein, 10 aa, Artificial Sequence
  Description of Artificial Sequence:  Synthetic Peptide
RESARLLFLY

SEQ ID NO: 3803 - protein, 10 aa, Artificial Sequence
  Description of Artificial Sequence:  Synthetic Peptide
HEAGRADRHV

SEQ ID NO: 3804 - protein, 9 aa, Artificial Sequence
  Description of Artificial Sequence:  Synthetic Peptide
VEVSHTAET

SEQ ID NO: 3805 - protein, 10 aa, Artificial Sequence
  Description of Artificial Sequence:  Synthetic Peptide
VEVSHTAETY

SEQ ID NO: 3806 - protein, 10 aa, Artificial Sequence
  Description of Artificial Sequence:  Synthetic Peptide
AETYAARANT

SEQ ID NO: 3807 - protein, 9 aa, Artificial Sequence
  Description of Artificial Sequence:  Synthetic Peptide
RERRRPCRY

SEQ ID NO: 3808 - protein, 9 aa, Artificial Sequence
  Description of Artificial Sequence:  Synthetic Peptide
CEAPGLHDA

SEQ ID NO: 3809 - protein, 10 aa, Artificial Sequence
  Description of Artificial Sequence:  Synthetic Peptide
SPTSWGTFRL

SEQ ID NO: 3810 - protein, 10 aa, Artificial Sequence
  Description of Artificial Sequence:  Synthetic Peptide
APQTPGVGRV

SEQ ID NO: 3811 - protein, 9 aa, Artificial Sequence
  Description of Artificial Sequence:  Synthetic Peptide
ATYQVTAWL

SEQ ID NO: 3812 - protein, 9 aa, Artificial Sequence
  Description of Artificial Sequence:  Synthetic Peptide
SPRIAGGRM

SEQ ID NO: 3813 - protein, 9 aa, Artificial Sequence
  Description of Artificial Sequence:  Synthetic Peptide
TPSKLGSLL

SEQ ID NO: 3814 - protein, 9 aa, Artificial Sequence
  Description of Artificial Sequence:  Synthetic Peptide
SLRGGVPSL

SEQ ID NO: 3815 - protein, 9 aa, Artificial Sequence
  Description of Artificial Sequence:  Synthetic Peptide
AAAPSTSSL

SEQ ID NO: 3816 - protein, 9 aa, Artificial Sequence
  Description of Artificial Sequence:  Synthetic Peptide
GVPSLTLCL

SEQ ID NO: 3817 - protein, 10 aa, Artificial Sequence
  Description of Artificial Sequence:  Synthetic Peptide
YPRRRCVAQC

SEQ ID NO: 3818 - protein, 10 aa, Artificial Sequence
  Description of Artificial Sequence:  Synthetic Peptide
GMTHPNRAVL

SEQ ID NO: 3819 - protein, 10 aa, Artificial Sequence
  Description of Artificial Sequence:  Synthetic Peptide
AQCIASPRVL

SEQ ID NO: 3820 - protein, 10 aa, Artificial Sequence
  Description of Artificial Sequence:  Synthetic Peptide
RTRGLIAGTM

SEQ ID NO: 3821 - protein, 10 aa, Artificial Sequence
  Description of Artificial Sequence:  Synthetic Peptide
YGRCSCSCWL

SEQ ID NO: 3822 - protein, 10 aa, Artificial Sequence
  Description of Artificial Sequence:  Synthetic Peptide
AGWSLGRHML

SEQ ID NO: 3823 - protein, 10 aa, Artificial Sequence
  Description of Artificial Sequence:  Synthetic Peptide
ELMPWTERWL

SEQ ID NO: 3824 - protein, 9 aa, Artificial Sequence
  Description of Artificial Sequence:  Synthetic Peptide
EAAMPSSSL

SEQ ID NO: 3825 - protein, 10 aa, Artificial Sequence
  Description of Artificial Sequence:  Synthetic Peptide
LPMVVALGAL

SEQ ID NO: 3826 - protein, 10 aa, Artificial Sequence
  Description of Artificial Sequence:  Synthetic Peptide
ASFLPMVVAL

SEQ ID NO: 3827 - protein, 9 aa, Artificial Sequence
  Description of Artificial Sequence:  Synthetic Peptide
GSMCPSYQL

SEQ ID NO: 3828 - protein, 10 aa, Artificial Sequence
  Description of Artificial Sequence:  Synthetic Peptide
SPSMAKPSPL

SEQ ID NO: 3829 - protein, 10 aa, Artificial Sequence
  Description of Artificial Sequence:  Synthetic Peptide
TSRRWPCLIL

SEQ ID NO: 3830 - protein, 10 aa, Artificial Sequence
  Description of Artificial Sequence:  Synthetic Peptide
AQSWTKRRRL

SEQ ID NO: 3831 - protein, 9 aa, Artificial Sequence
  Description of Artificial Sequence:  Synthetic Peptide
RPRLGCGPT

SEQ ID NO: 3832 - protein, 9 aa, Artificial Sequence
  Description of Artificial Sequence:  Synthetic Peptide
CPRPSRQET

SEQ ID NO: 3833 - protein, 10 aa, Artificial Sequence
  Description of Artificial Sequence:  Synthetic Peptide
CPRPSRQETT

SEQ ID NO: 3834 - protein, 9 aa, Artificial Sequence
  Description of Artificial Sequence:  Synthetic Peptide
QPPNKRRLL

SEQ ID NO: 3835 - protein, 9 aa, Artificial Sequence
  Description of Artificial Sequence:  Synthetic Peptide
APRTSLTLS

SEQ ID NO: 3836 - protein, 9 aa, Artificial Sequence
  Description of Artificial Sequence:  Synthetic Peptide
PPNKRRLLL

SEQ ID NO: 3837 - protein, 9 aa, Artificial Sequence
  Description of Artificial Sequence:  Synthetic Peptide
SAPRTSLTL

SEQ ID NO: 3838 - protein, 10 aa, Artificial Sequence
  Description of Artificial Sequence:  Synthetic Peptide
QPPNKRRLLL

SEQ ID NO: 3839 - protein, 9 aa, Artificial Sequence
  Description of Artificial Sequence:  Synthetic Peptide
RATPQRVLL

SEQ ID NO: 3840 - protein, 10 aa, Artificial Sequence
  Description of Artificial Sequence:  Synthetic Peptide
CLRATPQRVL

SEQ ID NO: 3841 - protein, 10 aa, Artificial Sequence
  Description of Artificial Sequence:  Synthetic Peptide
RVLLRSSPAL

SEQ ID NO: 3842 - protein, 9 aa, Artificial Sequence
  Description of Artificial Sequence:  Synthetic Peptide
TPRAPAHPL

SEQ ID NO: 3843 - protein, 9 aa, Artificial Sequence
  Description of Artificial Sequence:  Synthetic Peptide
HLPQRQTIL

SEQ ID NO: 3844 - protein, 9 aa, Artificial Sequence
  Description of Artificial Sequence:  Synthetic Peptide
LGRCGGWPL

SEQ ID NO: 3845 - protein, 9 aa, Artificial Sequence
  Description of Artificial Sequence:  Synthetic Peptide
SGRARITTL

SEQ ID NO: 3846 - protein, 9 aa, Artificial Sequence
  Description of Artificial Sequence:  Synthetic Peptide
NPRSSPQRC

SEQ ID NO: 3847 - protein, 9 aa, Artificial Sequence
  Description of Artificial Sequence:  Synthetic Peptide
ACGRRRSPL

SEQ ID NO: 3848 - protein, 10 aa, Artificial Sequence
  Description of Artificial Sequence:  Synthetic Peptide
QACGRRRSPL

SEQ ID NO: 3849 - protein, 9 aa, Artificial Sequence
  Description of Artificial Sequence:  Synthetic Peptide
CGRTCWKTL

SEQ ID NO: 3850 - protein, 9 aa, Artificial Sequence
  Description of Artificial Sequence:  Synthetic Peptide
YARRWPSMM

SEQ ID NO: 3851 - protein, 9 aa, Artificial Sequence
  Description of Artificial Sequence:  Synthetic Peptide
SMMWSPPFL

SEQ ID NO: 3852 - protein, 9 aa, Artificial Sequence
  Description of Artificial Sequence:  Synthetic Peptide
IPPPPSHGL

SEQ ID NO: 3853 - protein, 10 aa, Artificial Sequence
  Description of Artificial Sequence:  Synthetic Peptide
GLGRKQLDTL

SEQ ID NO: 3854 - protein, 9 aa, Artificial Sequence
  Description of Artificial Sequence:  Synthetic Peptide
CPRGGGPPL

SEQ ID NO: 3855 - protein, 10 aa, Artificial Sequence
  Description of Artificial Sequence:  Synthetic Peptide
CPRGGGPPLV

SEQ ID NO: 3856 - protein, 10 aa, Artificial Sequence
  Description of Artificial Sequence:  Synthetic Peptide
LAHFHSIVTL

SEQ ID NO: 3857 - protein, 9 aa, Artificial Sequence
  Description of Artificial Sequence:  Synthetic Peptide
SARLLFLYL

SEQ ID NO: 3858 - protein, 9 aa, Artificial Sequence
  Description of Artificial Sequence:  Synthetic Peptide
CNRESARLL

SEQ ID NO: 3859 - protein, 10 aa, Artificial Sequence
  Description of Artificial Sequence:  Synthetic Peptide
RPGSGGRREL

SEQ ID NO: 3860 - protein, 10 aa, Artificial Sequence
  Description of Artificial Sequence:  Synthetic Peptide
IPCHERLLQL

SEQ ID NO: 3861 - protein, 9 aa, Artificial Sequence
  Description of Artificial Sequence:  Synthetic Peptide
GGRARLCLL

SEQ ID NO: 3862 - protein, 10 aa, Artificial Sequence
  Description of Artificial Sequence:  Synthetic Peptide
SPGGRARLCL

SEQ ID NO: 3863 - protein, 10 aa, Artificial Sequence
  Description of Artificial Sequence:  Synthetic Peptide
LPSPGGRARL

SEQ ID NO: 3864 - protein, 9 aa, Artificial Sequence
  Description of Artificial Sequence:  Synthetic Peptide
FCRSGTLDL

SEQ ID NO: 3865 - protein, 9 aa, Artificial Sequence
  Description of Artificial Sequence:  Synthetic Peptide
LAGFTTTSL

SEQ ID NO: 3866 - protein, 10 aa, Artificial Sequence
  Description of Artificial Sequence:  Synthetic Peptide
ALAGFTTTSL

SEQ ID NO: 3867 - protein, 9 aa, Artificial Sequence
  Description of Artificial Sequence:  Synthetic Peptide
QPSYPATGL

SEQ ID NO: 3868 - protein, 9 aa, Artificial Sequence
  Description of Artificial Sequence:  Synthetic Peptide
GPRGPTRPC

SEQ ID NO: 3869 - protein, 10 aa, Artificial Sequence
  Description of Artificial Sequence:  Synthetic Peptide
AGRADRHVHL

SEQ ID NO: 3870 - protein, 9 aa, Artificial Sequence
  Description of Artificial Sequence:  Synthetic Peptide
AVSGLHGQL

SEQ ID NO: 3871 - protein, 10 aa, Artificial Sequence
  Description of Artificial Sequence:  Synthetic Peptide
HPGGCEGGGL

SEQ ID NO: 3872 - protein, 10 aa, Artificial Sequence
  Description of Artificial Sequence:  Synthetic Peptide
YAVSGLHGQL

SEQ ID NO: 3873 - protein, 9 aa, Artificial Sequence
  Description of Artificial Sequence:  Synthetic Peptide
DSRLQGSHL

SEQ ID NO: 3874 - protein, 9 aa, Artificial Sequence
  Description of Artificial Sequence:  Synthetic Peptide
AARANTLAV

SEQ ID NO: 3875 - protein, 10 aa, Artificial Sequence
  Description of Artificial Sequence:  Synthetic Peptide
SAHFHAHRPL

SEQ ID NO: 3876 - protein, 9 aa, Artificial Sequence
  Description of Artificial Sequence:  Synthetic Peptide
AAHQRVEQL

SEQ ID NO: 3877 - protein, 10 aa, Artificial Sequence
  Description of Artificial Sequence:  Synthetic Peptide
QAAHQRVEQL

SEQ ID NO: 3878 - protein, 10 aa, Artificial Sequence
  Description of Artificial Sequence:  Synthetic Peptide
RPRCIRQKGV

SEQ ID NO: 3879 - protein, 10 aa, Artificial Sequence
  Description of Artificial Sequence:  Synthetic Peptide
MPQETWGTTL

SEQ ID NO: 3880 - protein, 9 aa, Artificial Sequence
  Description of Artificial Sequence:  Synthetic Peptide
VVQPPGPPL

SEQ ID NO: 3881 - protein, 10 aa, Artificial Sequence
  Description of Artificial Sequence:  Synthetic Peptide
SVVQPPGPPL

SEQ ID NO: 3882 - protein, 10 aa, Artificial Sequence
  Description of Artificial Sequence:  Synthetic Peptide
LCLTSRTRGL

SEQ ID NO: 3883 - protein, 10 aa, Artificial Sequence
  Description of Artificial Sequence:  Synthetic Peptide
SPSMAKPSPL

SEQ ID NO: 3884 - protein, 9 aa, Artificial Sequence
  Description of Artificial Sequence:  Synthetic Peptide
QPPNKRRLL

SEQ ID NO: 3885 - protein, 10 aa, Artificial Sequence
  Description of Artificial Sequence:  Synthetic Peptide
QPPNKRRLLL

SEQ ID NO: 3886 - protein, 9 aa, Artificial Sequence
  Description of Artificial Sequence:  Synthetic Peptide
HPLQRQTIL

SEQ ID NO: 3887 - protein, 9 aa, Artificial Sequence
  Description of Artificial Sequence:  Synthetic Peptide
TPRAPAHPL

SEQ ID NO: 3888 - protein, 9 aa, Artificial Sequence
  Description of Artificial Sequence:  Synthetic Peptide
SGRARITTL

SEQ ID NO: 3889 - protein, 9 aa, Artificial Sequence
  Description of Artificial Sequence:  Synthetic Peptide
ACGRRRSPL

SEQ ID NO: 3890 - protein, 10 aa, Artificial Sequence
  Description of Artificial Sequence:  Synthetic Peptide
QACGRRRSPL

SEQ ID NO: 3891 - protein, 9 aa, Artificial Sequence
  Description of Artificial Sequence:  Synthetic Peptide
CPRGGGPPL

SEQ ID NO: 3892 - protein, 9 aa, Artificial Sequence
  Description of Artificial Sequence:  Synthetic Peptide
SARLLFLYL

SEQ ID NO: 3893 - protein, 10 aa, Artificial Sequence
  Description of Artificial Sequence:  Synthetic Peptide
IPCHERLLQL

SEQ ID NO: 3894 - protein, 9 aa, Artificial Sequence
  Description of Artificial Sequence:  Synthetic Peptide
GGRARLCLL

SEQ ID NO: 3895 - protein, 9 aa, Artificial Sequence
  Description of Artificial Sequence:  Synthetic Peptide
FCRSGTLDL

SEQ ID NO: 3896 - protein, 10 aa, Artificial Sequence
  Description of Artificial Sequence:  Synthetic Peptide
AGRADRHVHL

SEQ ID NO: 3897 - protein, 9 aa, Artificial Sequence
  Description of Artificial Sequence:  Synthetic Peptide
AAHQRVEQL

SEQ ID NO: 3898 - protein, 10 aa, Artificial Sequence
  Description of Artificial Sequence:  Synthetic Peptide
QAAHQRVEQL

SEQ ID NO: 3899 - protein, 9 aa, Artificial Sequence
  Description of Artificial Sequence:  Synthetic Peptide
DARERRRPC

SEQ ID NO: 3900 - protein, 10 aa, Artificial Sequence
  Description of Artificial Sequence:  Synthetic Peptide
RPRCIRQKGV

SEQ ID NO: 3901 - protein, 10 aa, Artificial Sequence
  Description of Artificial Sequence:  Synthetic Peptide
ICREASISTL

SEQ ID NO: 3902 - protein, 10 aa, Artificial Sequence
  Description of Artificial Sequence:  Synthetic Peptide
ICREASISTL

SEQ ID NO: 3903 - protein, 9 aa, Artificial Sequence
  Description of Artificial Sequence:  Synthetic Peptide
REASISTLC

SEQ ID NO: 3904 - protein, 10 aa, Artificial Sequence
  Description of Artificial Sequence:  Synthetic Peptide
REASISTLCS

SEQ ID NO: 3905 - protein, 9 aa, Artificial Sequence
  Description of Artificial Sequence:  Synthetic Peptide
CLPLQKVGV

SEQ ID NO: 3906 - protein, 9 aa, Artificial Sequence
  Description of Artificial Sequence:  Synthetic Peptide
WPGVFSSPF

SEQ ID NO: 3907 - protein, 9 aa, Artificial Sequence
  Description of Artificial Sequence:  Synthetic Peptide
MMLSAPSRI

SEQ ID NO: 3908 - protein, 10 aa, Artificial Sequence
  Description of Artificial Sequence:  Synthetic Peptide
MLSAPSRILV

SEQ ID NO: 3909 - protein, 10 aa, Artificial Sequence
  Description of Artificial Sequence:  Synthetic Peptide
NMMLSAPSRI

SEQ ID NO: 3910 - protein, 9 aa, Artificial Sequence
  Description of Artificial Sequence:  Synthetic Peptide
RPTHWRNMM

SEQ ID NO: 3911 - protein, 10 aa, Artificial Sequence
  Description of Artificial Sequence:  Synthetic Peptide
RPTHWRNMML

SEQ ID NO: 3912 - protein, 10 aa, Artificial Sequence
  Description of Artificial Sequence:  Synthetic Peptide
RGRPTHWRNM

SEQ ID NO: 3913 - protein, 9 aa, Artificial Sequence
  Description of Artificial Sequence:  Synthetic Peptide
RPTHWRNMM

SEQ ID NO: 3914 - protein, 10 aa, Artificial Sequence
  Description of Artificial Sequence:  Synthetic Peptide
RPTHWRNMML

SEQ ID NO: 3915 - protein, 10 aa, Artificial Sequence
  Description of Artificial Sequence:  Synthetic Peptide
RGRPTHWRNM

SEQ ID NO: 3916 - protein, 10 aa, Artificial Sequence
  Description of Artificial Sequence:  Synthetic Peptide
RLAAQESTGI

SEQ ID NO: 3917 - protein, 9 aa, Artificial Sequence
  Description of Artificial Sequence:  Synthetic Peptide
RYSPGTRLA

SEQ ID NO: 3918 - protein, 10 aa, Artificial Sequence
  Description of Artificial Sequence:  Synthetic Peptide
RGPSSRIHGL

SEQ ID NO: 3919 - protein, 10 aa, Artificial Sequence
  Description of Artificial Sequence:  Synthetic Peptide
RYSPGTRLAA

SEQ ID NO: 3920 - protein, 9 aa, Artificial Sequence
  Description of Artificial Sequence:  Synthetic Peptide
GPSSRIHGL

SEQ ID NO: 3921 - protein, 10 aa, Artificial Sequence
  Description of Artificial Sequence:  Synthetic Peptide
ISRYSPGTRL

SEQ ID NO: 3922 - protein, 10 aa, Artificial Sequence
  Description of Artificial Sequence:  Synthetic Peptide
SSRIHGLPDL

SEQ ID NO: 3923 - protein, 9 aa, Artificial Sequence
  Description of Artificial Sequence:  Synthetic Peptide
GPSSRIHGL

SEQ ID NO: 3924 - protein, 9 aa, Artificial Sequence
  Description of Artificial Sequence:  Synthetic Peptide
GPSSRIHGL

SEQ ID NO: 3925 - protein, 9 aa, Artificial Sequence
  Description of Artificial Sequence:  Synthetic Peptide
SPSRPEEGW

SEQ ID NO: 3926 - protein, 10 aa, Artificial Sequence
  Description of Artificial Sequence:  Synthetic Peptide
ISRYSPGTRL

SEQ ID NO: 3927 - protein, 10 aa, Artificial Sequence
  Description of Artificial Sequence:  Synthetic Peptide
SSRIHGLPDL

SEQ ID NO: 3928 - protein, 10 aa, Artificial Sequence
  Description of Artificial Sequence:  Synthetic Peptide
AAQESTGIRM

SEQ ID NO: 3929 - protein, 10 aa, Artificial Sequence
  Description of Artificial Sequence:  Synthetic Peptide
AEWISLLSTV

SEQ ID NO: 3930 - protein, 10 aa, Artificial Sequence
  Description of Artificial Sequence:  Synthetic Peptide
SMMLLRGSQA

SEQ ID NO: 3931 - protein, 10 aa, Artificial Sequence
  Description of Artificial Sequence:  Synthetic Peptide
AEWISLLSTV

SEQ ID NO: 3932 - protein, 9 aa, Artificial Sequence
  Description of Artificial Sequence:  Synthetic Peptide
QQPPLVWWL

SEQ ID NO: 3933 - protein, 9 aa, Artificial Sequence
  Description of Artificial Sequence:  Synthetic Peptide
WLFAVTRAL

SEQ ID NO: 3934 - protein, 9 aa, Artificial Sequence
  Description of Artificial Sequence:  Synthetic Peptide
PLVWWLFAV

SEQ ID NO: 3935 - protein, 10 aa, Artificial Sequence
  Description of Artificial Sequence:  Synthetic Peptide
EQQPPLVWWL

SEQ ID NO: 3936 - protein, 9 aa, Artificial Sequence
  Description of Artificial Sequence:  Synthetic Peptide
GLATWTPPR

SEQ ID NO: 3937 - protein, 9 aa, Artificial Sequence
  Description of Artificial Sequence:  Synthetic Peptide
PPREQQPPL

SEQ ID NO: 3938 - protein, 10 aa, Artificial Sequence
  Description of Artificial Sequence:  Synthetic Peptide
TPPREQQPPL

SEQ ID NO: 3939 - protein, 9 aa, Artificial Sequence
  Description of Artificial Sequence:  Synthetic Peptide
QPPLVWWLF

SEQ ID NO: 3940 - protein, 9 aa, Artificial Sequence
  Description of Artificial Sequence:  Synthetic Peptide
PPREQQPPL

SEQ ID NO: 3941 - protein, 10 aa, Artificial Sequence
  Description of Artificial Sequence:  Synthetic Peptide
TPPREQQPPL

SEQ ID NO: 3942 - protein, 10 aa, Artificial Sequence
  Description of Artificial Sequence:  Synthetic Peptide
REQQPPLVWW

SEQ ID NO: 3943 - protein, 10 aa, Artificial Sequence
  Description of Artificial Sequence:  Synthetic Peptide
GMLPGRGSCL

SEQ ID NO: 3944 - protein, 10 aa, Artificial Sequence
  Description of Artificial Sequence:  Synthetic Peptide
MLPGRGSCLL

SEQ ID NO: 3945 - protein, 9 aa, Artificial Sequence
  Description of Artificial Sequence:  Synthetic Peptide
CLLPAWSGT

SEQ ID NO: 3946 - protein, 9 aa, Artificial Sequence
  Description of Artificial Sequence:  Synthetic Peptide
MLPGRGSCL

SEQ ID NO: 3947 - protein, 9 aa, Artificial Sequence
  Description of Artificial Sequence:  Synthetic Peptide
LPGRGSCLL

SEQ ID NO: 3948 - protein, 10 aa, Artificial Sequence
  Description of Artificial Sequence:  Synthetic Peptide
EPWRTPWLGM

SEQ ID NO: 3949 - protein, 10 aa, Artificial Sequence
  Description of Artificial Sequence:  Synthetic Peptide
GPEPWRTPWL

SEQ ID NO: 3950 - protein, 10 aa, Artificial Sequence
  Description of Artificial Sequence:  Synthetic Peptide
EPWRTPWLGM

SEQ ID NO: 3951 - protein, 9 aa, Artificial Sequence
  Description of Artificial Sequence:  Synthetic Peptide
LPGRGSCLL

SEQ ID NO: 3952 - protein, 10 aa, Artificial Sequence
  Description of Artificial Sequence:  Synthetic Peptide
MEVGPEPWRT

SEQ ID NO: 3953 - protein, 9 aa, Artificial Sequence
  Description of Artificial Sequence:  Synthetic Peptide
RLLPRQRRL

SEQ ID NO: 3954 - protein, 9 aa, Artificial Sequence
  Description of Artificial Sequence:  Synthetic Peptide
PYSPSSERL

SEQ ID NO: 3955 - protein, 9 aa, Artificial Sequence
  Description of Artificial Sequence:  Synthetic Peptide
RLLPRQRRL

SEQ ID NO: 3956 - protein, 10 aa, Artificial Sequence
  Description of Artificial Sequence:  Synthetic Peptide
PYSPSSERLL

SEQ ID NO: 3957 - protein, 10 aa, Artificial Sequence
  Description of Artificial Sequence:  Synthetic Peptide
RPYSPSSERL

SEQ ID NO: 3958 - protein, 9 aa, Artificial Sequence
  Description of Artificial Sequence:  Synthetic Peptide
RSLSQSRPY

SEQ ID NO: 3959 - protein, 10 aa, Artificial Sequence
  Description of Artificial Sequence:  Synthetic Peptide
RPYSPSSERL

SEQ ID NO: 3960 - protein, 9 aa, Artificial Sequence
  Description of Artificial Sequence:  Synthetic Peptide
RLLPRQRRL

SEQ ID NO: 3961 - protein, 9 aa, Artificial Sequence
  Description of Artificial Sequence:  Synthetic Peptide
PYSPSSERL

SEQ ID NO: 3962 - protein, 9 aa, Artificial Sequence
  Description of Artificial Sequence:  Synthetic Peptide
RLLPRQRRL

SEQ ID NO: 3963 - protein, 10 aa, Artificial Sequence
  Description of Artificial Sequence:  Synthetic Peptide
PYSPSSERLL

SEQ ID NO: 3964 - protein, 10 aa, Artificial Sequence
  Description of Artificial Sequence:  Synthetic Peptide
RPYSPSSERL

SEQ ID NO: 3965 - protein, 9 aa, Artificial Sequence
  Description of Artificial Sequence:  Synthetic Peptide
RSLSQSRPY

SEQ ID NO: 3966 - protein, 10 aa, Artificial Sequence
  Description of Artificial Sequence:  Synthetic Peptide
RPYSPSSERL

SEQ ID NO: 3967 - protein, 9 aa, Artificial Sequence
  Description of Artificial Sequence:  Synthetic Peptide
AVRPGGMSC

SEQ ID NO: 3968 - protein, 10 aa, Artificial Sequence
  Description of Artificial Sequence:  Synthetic Peptide
SLGPWHKLVV

SEQ ID NO: 3969 - protein, 10 aa, Artificial Sequence
  Description of Artificial Sequence:  Synthetic Peptide
KLVVVKPARA

SEQ ID NO: 3970 - protein, 10 aa, Artificial Sequence
  Description of Artificial Sequence:  Synthetic Peptide
RVPDLQKPRL

SEQ ID NO: 3971 - protein, 9 aa, Artificial Sequence
  Description of Artificial Sequence:  Synthetic Peptide
KLVVVKPAR

SEQ ID NO: 3972 - protein, 9 aa, Artificial Sequence
  Description of Artificial Sequence:  Synthetic Peptide
MPPQGPACL

SEQ ID NO: 3973 - protein, 9 aa, Artificial Sequence
  Description of Artificial Sequence:  Synthetic Peptide
RLRTMQPSL

SEQ ID NO: 3974 - protein, 9 aa, Artificial Sequence
  Description of Artificial Sequence:  Synthetic Peptide
VTRSRVPDL

SEQ ID NO: 3975 - protein, 9 aa, Artificial Sequence
  Description of Artificial Sequence:  Synthetic Peptide
VPDLQKPRL

SEQ ID NO: 3976 - protein, 10 aa, Artificial Sequence
  Description of Artificial Sequence:  Synthetic Peptide
QPSLGPWHKL

SEQ ID NO: 3977 - protein, 10 aa, Artificial Sequence
  Description of Artificial Sequence:  Synthetic Peptide
MVTRSRVPDL

SEQ ID NO: 3978 - protein, 10 aa, Artificial Sequence
  Description of Artificial Sequence:  Synthetic Peptide
RVPDLQKPRL

SEQ ID NO: 3979 - protein, 9 aa, Artificial Sequence
  Description of Artificial Sequence:  Synthetic Peptide
VTRSRVPDL

SEQ ID NO: 3980 - protein, 10 aa, Artificial Sequence
  Description of Artificial Sequence:  Synthetic Peptide
QPSLGPWHKL

SEQ ID NO: 3981 - protein, 10 aa, Artificial Sequence
  Description of Artificial Sequence:  Synthetic Peptide
KPARAGATAI

SEQ ID NO: 3982 - protein, 10 aa, Artificial Sequence
  Description of Artificial Sequence:  Synthetic Peptide
KPRLRTMQPS

SEQ ID NO: 3983 - protein, 10 aa, Artificial Sequence
  Description of Artificial Sequence:  Synthetic Peptide
RTRGSGCWRL

SEQ ID NO: 3984 - protein, 9 aa, Artificial Sequence
  Description of Artificial Sequence:  Synthetic Peptide
CARQRQQRV

SEQ ID NO: 3985 - protein, 9 aa, Artificial Sequence
  Description of Artificial Sequence:  Synthetic Peptide
VLEAARHSY

SEQ ID NO: 3986 - protein, 10 aa, Artificial Sequence
  Description of Artificial Sequence:  Synthetic Peptide
ALPGGGVLEA

SEQ ID NO: 3987 - protein, 9 aa, Artificial Sequence
  Description of Artificial Sequence:  Synthetic Peptide
MALPGGGVL

SEQ ID NO: 3988 - protein, 10 aa, Artificial Sequence
  Description of Artificial Sequence:  Synthetic Peptide
NQRGRARDRL

SEQ ID NO: 3989 - protein, 10 aa, Artificial Sequence
  Description of Artificial Sequence:  Synthetic Peptide
MLPSQELTGV

SEQ ID NO: 3990 - protein, 9 aa, Artificial Sequence
  Description of Artificial Sequence:  Synthetic Peptide
MIMLPSQEL

SEQ ID NO: 3991 - protein, 9 aa, Artificial Sequence
  Description of Artificial Sequence:  Synthetic Peptide
IMLPSQELT

SEQ ID NO: 3992 - protein, 9 aa, Artificial Sequence
  Description of Artificial Sequence:  Synthetic Peptide
MIMLPSQEL

SEQ ID NO: 3993 - protein, 10 aa, Artificial Sequence
  Description of Artificial Sequence:  Synthetic Peptide
QELTGVCLAV

SEQ ID NO: 3994 - protein, 9 aa, Artificial Sequence
  Description of Artificial Sequence:  Synthetic Peptide
QELTGVCLA

SEQ ID NO: 3995 - protein, 10 aa, Artificial Sequence
  Description of Artificial Sequence:  Synthetic Peptide
TVESKQRVSY

SEQ ID NO: 3996 - protein, 9 aa, Artificial Sequence
  Description of Artificial Sequence:  Synthetic Peptide
MGFFFDFQV

SEQ ID NO: 3997 - protein, 10 aa, Artificial Sequence
  Description of Artificial Sequence:  Synthetic Peptide
PMGFFFDFQV

SEQ ID NO: 3998 - protein, 9 aa, Artificial Sequence
  Description of Artificial Sequence:  Synthetic Peptide
SYEKPMGFF

SEQ ID NO: 3999 - protein, 9 aa, Artificial Sequence
  Description of Artificial Sequence:  Synthetic Peptide
GFFFDFQVF

SEQ ID NO: 4000 - protein, 10 aa, Artificial Sequence
  Description of Artificial Sequence:  Synthetic Peptide
SYEKPMGFFF

SEQ ID NO: 4001 - protein, 10 aa, Artificial Sequence
  Description of Artificial Sequence:  Synthetic Peptide
EYWNPYEEPI

SEQ ID NO: 4002 - protein, 10 aa, Artificial Sequence
  Description of Artificial Sequence:  Synthetic Peptide
KQRVSYEKPM

SEQ ID NO: 4003 - protein, 10 aa, Artificial Sequence
  Description of Artificial Sequence:  Synthetic Peptide
KQRVSYEKPM

SEQ ID NO: 4004 - protein, 10 aa, Artificial Sequence
  Description of Artificial Sequence:  Synthetic Peptide
VSYEKPMGFF

SEQ ID NO: 4005 - protein, 9 aa, Artificial Sequence
  Description of Artificial Sequence:  Synthetic Peptide
CPGEYWNPY

SEQ ID NO: 4006 - protein, 9 aa, Artificial Sequence
  Description of Artificial Sequence:  Synthetic Peptide
KPMGFFFDF

SEQ ID NO: 4007 - protein, 9 aa, Artificial Sequence
  Description of Artificial Sequence:  Synthetic Peptide
VSYEKPMGF

SEQ ID NO: 4008 - protein, 9 aa, Artificial Sequence
  Description of Artificial Sequence:  Synthetic Peptide
NSTRCPGEY

SEQ ID NO: 4009 - protein, 9 aa, Artificial Sequence
  Description of Artificial Sequence:  Synthetic Peptide
YEKPMGFFF

SEQ ID NO: 4010 - protein, 9 aa, Artificial Sequence
  Description of Artificial Sequence:  Synthetic Peptide
VESKQRVSY

SEQ ID NO: 4011 - protein, 9 aa, Artificial Sequence
  Description of Artificial Sequence:  Synthetic Peptide
HTEWMWLTA

SEQ ID NO: 4012 - protein, 10 aa, Artificial Sequence
  Description of Artificial Sequence:  Synthetic Peptide
MMVVSIGVTV

SEQ ID NO: 4013 - protein, 10 aa, Artificial Sequence
  Description of Artificial Sequence:  Synthetic Peptide
LLDRFRTSFA

SEQ ID NO: 4014 - protein, 10 aa, Artificial Sequence
  Description of Artificial Sequence:  Synthetic Peptide
KSFHTEWMWL

SEQ ID NO: 4015 - protein, 9 aa, Artificial Sequence
  Description of Artificial Sequence:  Synthetic Peptide
MVVSIGVTV

SEQ ID NO: 4016 - protein, 9 aa, Artificial Sequence
  Description of Artificial Sequence:  Synthetic Peptide
SFHTEWMWL

SEQ ID NO: 4017 - protein, 10 aa, Artificial Sequence
  Description of Artificial Sequence:  Synthetic Peptide
WMWLTALLDR

SEQ ID NO: 4018 - protein, 10 aa, Artificial Sequence
  Description of Artificial Sequence:  Synthetic Peptide
SSKSFHTEWM

SEQ ID NO: 4019 - protein, 10 aa, Artificial Sequence
  Description of Artificial Sequence:  Synthetic Peptide
KSFHTEWMWL

SEQ ID NO: 4020 - protein, 10 aa, Artificial Sequence
  Description of Artificial Sequence:  Synthetic Peptide
SLLSSAAHGV

SEQ ID NO: 4021 - protein, 10 aa, Artificial Sequence
  Description of Artificial Sequence:  Synthetic Peptide
MLWWRSKELL

SEQ ID NO: 4022 - protein, 10 aa, Artificial Sequence
  Description of Artificial Sequence:  Synthetic Peptide
ALMGSLLSSA

SEQ ID NO: 4023 - protein, 10 aa, Artificial Sequence
  Description of Artificial Sequence:  Synthetic Peptide
LLNALMGSLL

SEQ ID NO: 4024 - protein, 9 aa, Artificial Sequence
  Description of Artificial Sequence:  Synthetic Peptide
RSKELLNAL

SEQ ID NO: 4025 - protein, 9 aa, Artificial Sequence
  Description of Artificial Sequence:  Synthetic Peptide
RSKELLNAL

SEQ ID NO: 4026 - protein, 10 aa, Artificial Sequence
  Description of Artificial Sequence:  Synthetic Peptide
RSKELLNALM

SEQ ID NO: 4027 - protein, 10 aa, Artificial Sequence
  Description of Artificial Sequence:  Synthetic Peptide
KELLNALMGS

SEQ ID NO: 4028 - protein, 9 aa, Artificial Sequence
  Description of Artificial Sequence:  Synthetic Peptide
TADDSELPK

SEQ ID NO: 4029 - protein, 9 aa, Artificial Sequence
  Description of Artificial Sequence:  Synthetic Peptide
TSDPLSPSS

SEQ ID NO: 4030 - protein, 9 aa, Artificial Sequence
  Description of Artificial Sequence:  Synthetic Peptide
EYDSTSDPL

SEQ ID NO: 4031 - protein, 9 aa, Artificial Sequence
  Description of Artificial Sequence:  Synthetic Peptide
RGGGIGGAL

SEQ ID NO: 4032 - protein, 9 aa, Artificial Sequence
  Description of Artificial Sequence:  Synthetic Peptide
SVRTTVLFL

SEQ ID NO: 4033 - protein, 9 aa, Artificial Sequence
  Description of Artificial Sequence:  Synthetic Peptide
SGRAVAVPL

SEQ ID NO: 4034 - protein, 10 aa, Artificial Sequence
  Description of Artificial Sequence:  Synthetic Peptide
DPLSPSSEAW

SEQ ID NO: 4035 - protein, 10 aa, Artificial Sequence
  Description of Artificial Sequence:  Synthetic Peptide
SELPKVLVAS

SEQ ID NO: 4036 - protein, 10 aa, Artificial Sequence
  Description of Artificial Sequence:  Synthetic Peptide
SEAWSGRAVA

SEQ ID NO: 4037 - protein, 9 aa, Artificial Sequence
  Description of Artificial Sequence:  Synthetic Peptide
SELPKVLVA

SEQ ID NO: 4038 - protein, 9 aa, Artificial Sequence
  Description of Artificial Sequence:  Synthetic Peptide
SEAWSGRAV

SEQ ID NO: 4039 - protein, 9 aa, Artificial Sequence
  Description of Artificial Sequence:  Synthetic Peptide
FSDSTRVMF

SEQ ID NO: 4040 - protein, 9 aa, Artificial Sequence
  Description of Artificial Sequence:  Synthetic Peptide
GGDPLANLR

SEQ ID NO: 4041 - protein, 9 aa, Artificial Sequence
  Description of Artificial Sequence:  Synthetic Peptide
SCDPTRYWL

SEQ ID NO: 4042 - protein, 10 aa, Artificial Sequence
  Description of Artificial Sequence:  Synthetic Peptide
RSASGETWWV

SEQ ID NO: 4043 - protein, 9 aa, Artificial Sequence
  Description of Artificial Sequence:  Synthetic Peptide
TLFSDSTRV

SEQ ID NO: 4044 - protein, 9 aa, Artificial Sequence
  Description of Artificial Sequence:  Synthetic Peptide
VMWEGSVSM

SEQ ID NO: 4045 - protein, 9 aa, Artificial Sequence
  Description of Artificial Sequence:  Synthetic Peptide
SASGETWWV

SEQ ID NO: 4046 - protein, 9 aa, Artificial Sequence
  Description of Artificial Sequence:  Synthetic Peptide
FTLSVVMPV

SEQ ID NO: 4047 - protein, 9 aa, Artificial Sequence
  Description of Artificial Sequence:  Synthetic Peptide
YLCNRTPST

SEQ ID NO: 4048 - protein, 9 aa, Artificial Sequence
  Description of Artificial Sequence:  Synthetic Peptide
WLSPTWNVT

SEQ ID NO: 4049 - protein, 9 aa, Artificial Sequence
  Description of Artificial Sequence:  Synthetic Peptide
GTWHGHFTL

SEQ ID NO: 4050 - protein, 9 aa, Artificial Sequence
  Description of Artificial Sequence:  Synthetic Peptide
NLRLAVSAV

SEQ ID NO: 4051 - protein, 9 aa, Artificial Sequence
  Description of Artificial Sequence:  Synthetic Peptide
RGLHAGAYL

SEQ ID NO: 4052 - protein, 9 aa, Artificial Sequence
  Description of Artificial Sequence:  Synthetic Peptide
RYWLSPTWN

SEQ ID NO: 4053 - protein, 10 aa, Artificial Sequence
  Description of Artificial Sequence:  Synthetic Peptide
AFKEGADNWL

SEQ ID NO: 4054 - protein, 10 aa, Artificial Sequence
  Description of Artificial Sequence:  Synthetic Peptide
LFSDSTRVMF

SEQ ID NO: 4055 - protein, 10 aa, Artificial Sequence
  Description of Artificial Sequence:  Synthetic Peptide
RYWLSPTWNV

SEQ ID NO: 4056 - protein, 9 aa, Artificial Sequence
  Description of Artificial Sequence:  Synthetic Peptide
VMFPPISCR

SEQ ID NO: 4057 - protein, 9 aa, Artificial Sequence
  Description of Artificial Sequence:  Synthetic Peptide
LAKEGGDPL

SEQ ID NO: 4058 - protein, 10 aa, Artificial Sequence
  Description of Artificial Sequence:  Synthetic Peptide
AVMWEGSVSM

SEQ ID NO: 4059 - protein, 10 aa, Artificial Sequence
  Description of Artificial Sequence:  Synthetic Peptide
NVTSSRRRGL

SEQ ID NO: 4060 - protein, 10 aa, Artificial Sequence
  Description of Artificial Sequence:  Synthetic Peptide
AGTWHGHFTL

SEQ ID NO: 4061 - protein, 10 aa, Artificial Sequence
  Description of Artificial Sequence:  Synthetic Peptide
SCRHRRLASM

SEQ ID NO: 4062 - protein, 10 aa, Artificial Sequence
  Description of Artificial Sequence:  Synthetic Peptide
NLRLAVSAVM

SEQ ID NO: 4063 - protein, 10 aa, Artificial Sequence
  Description of Artificial Sequence:  Synthetic Peptide
GSKESRTTTL

SEQ ID NO: 4064 - protein, 10 aa, Artificial Sequence
  Description of Artificial Sequence:  Synthetic Peptide
SCRHRRLASM

SEQ ID NO: 4065 - protein, 9 aa, Artificial Sequence
  Description of Artificial Sequence:  Synthetic Peptide
LAKEGGDPL

SEQ ID NO: 4066 - protein, 9 aa, Artificial Sequence
  Description of Artificial Sequence:  Synthetic Peptide
LAKEGGDPL

SEQ ID NO: 4067 - protein, 10 aa, Artificial Sequence
  Description of Artificial Sequence:  Synthetic Peptide
GSKESRTTTL

SEQ ID NO: 4068 - protein, 10 aa, Artificial Sequence
  Description of Artificial Sequence:  Synthetic Peptide
GSCDPTRYWL

SEQ ID NO: 4069 - protein, 10 aa, Artificial Sequence
  Description of Artificial Sequence:  Synthetic Peptide
SEKNSGAGTW

SEQ ID NO: 4070 - protein, 10 aa, Artificial Sequence
  Description of Artificial Sequence:  Synthetic Peptide
MEVSTATSGS

SEQ ID NO: 4071 - protein, 10 aa, Artificial Sequence
  Description of Artificial Sequence:  Synthetic Peptide
GETWWVVHVA

SEQ ID NO: 4072 - protein, 9 aa, Artificial Sequence
  Description of Artificial Sequence:  Synthetic Peptide
KESRTTTLF

SEQ ID NO: 4073 - protein, 9 aa, Artificial Sequence
  Description of Artificial Sequence:  Synthetic Peptide
GETWWVVHV

SEQ ID NO: 4074 - protein, 9 aa, Artificial Sequence
  Description of Artificial Sequence:  Synthetic Peptide
SLDWSQVLK

SEQ ID NO: 4075 - protein, 10 aa, Artificial Sequence
  Description of Artificial Sequence:  Synthetic Peptide
SLSHEPEHGV

SEQ ID NO: 4076 - protein, 10 aa, Artificial Sequence
  Description of Artificial Sequence:  Synthetic Peptide
VLLQVLGPTI

SEQ ID NO: 4077 - protein, 10 aa, Artificial Sequence
  Description of Artificial Sequence:  Synthetic Peptide
MMPSPRQTPL

SEQ ID NO: 4078 - protein, 10 aa, Artificial Sequence
  Description of Artificial Sequence:  Synthetic Peptide
SQVLKSVNTV

SEQ ID NO: 4079 - protein, 10 aa, Artificial Sequence
  Description of Artificial Sequence:  Synthetic Peptide
LLQVLGPTIL

SEQ ID NO: 4080 - protein, 10 aa, Artificial Sequence
  Description of Artificial Sequence:  Synthetic Peptide
NVPCHVLLQV

SEQ ID NO: 4081 - protein, 9 aa, Artificial Sequence
  Description of Artificial Sequence:  Synthetic Peptide
ILMEPFLTC

SEQ ID NO: 4082 - protein, 9 aa, Artificial Sequence
  Description of Artificial Sequence:  Synthetic Peptide
FLTCPVICA

SEQ ID NO: 4083 - protein, 9 aa, Artificial Sequence
  Description of Artificial Sequence:  Synthetic Peptide
QVLKSVNTV

SEQ ID NO: 4084 - protein, 9 aa, Artificial Sequence
  Description of Artificial Sequence:  Synthetic Peptide
TILMEPFLT

SEQ ID NO: 4085 - protein, 9 aa, Artificial Sequence
  Description of Artificial Sequence:  Synthetic Peptide
LLQVLGPTI

SEQ ID NO: 4086 - protein, 9 aa, Artificial Sequence
  Description of Artificial Sequence:  Synthetic Peptide
VLLQVLGPT

SEQ ID NO: 4087 - protein, 9 aa, Artificial Sequence
  Description of Artificial Sequence:  Synthetic Peptide
RSLDWSQVL

SEQ ID NO: 4088 - protein, 10 aa, Artificial Sequence
  Description of Artificial Sequence:  Synthetic Peptide
PLYPRWHEKK

SEQ ID NO: 4089 - protein, 9 aa, Artificial Sequence
  Description of Artificial Sequence:  Synthetic Peptide
SLDWSQVLK

SEQ ID NO: 4090 - protein, 9 aa, Artificial Sequence
  Description of Artificial Sequence:  Synthetic Peptide
PLYPRWHEK

SEQ ID NO: 4091 - protein, 9 aa, Artificial Sequence
  Description of Artificial Sequence:  Synthetic Peptide
MPSPRQTPL

SEQ ID NO: 4092 - protein, 9 aa, Artificial Sequence
  Description of Artificial Sequence:  Synthetic Peptide
TPGSCGRSL

SEQ ID NO: 4093 - protein, 9 aa, Artificial Sequence
  Description of Artificial Sequence:  Synthetic Peptide
APHGQVVCM

SEQ ID NO: 4094 - protein, 10 aa, Artificial Sequence
  Description of Artificial Sequence:  Synthetic Peptide
VPCHVLLQVL

SEQ ID NO: 4095 - protein, 10 aa, Artificial Sequence
  Description of Artificial Sequence:  Synthetic Peptide
GPTILMEPFL

SEQ ID NO: 4096 - protein, 10 aa, Artificial Sequence
  Description of Artificial Sequence:  Synthetic Peptide
APHGQVVCMM

SEQ ID NO: 4097 - protein, 10 aa, Artificial Sequence
  Description of Artificial Sequence:  Synthetic Peptide
TVHIQSQTSL

SEQ ID NO: 4098 - protein, 10 aa, Artificial Sequence
  Description of Artificial Sequence:  Synthetic Peptide
YPRWHEKKGT

SEQ ID NO: 4099 - protein, 9 aa, Artificial Sequence
  Description of Artificial Sequence:  Synthetic Peptide
MPSPRQTPL

SEQ ID NO: 4100 - protein, 9 aa, Artificial Sequence
  Description of Artificial Sequence:  Synthetic Peptide
APHGQVVCM

SEQ ID NO: 4101 - protein, 9 aa, Artificial Sequence
  Description of Artificial Sequence:  Synthetic Peptide
GPTILMEPF

SEQ ID NO: 4102 - protein, 9 aa, Artificial Sequence
  Description of Artificial Sequence:  Synthetic Peptide
MPSPRQTPL

SEQ ID NO: 4103 - protein, 9 aa, Artificial Sequence
  Description of Artificial Sequence:  Synthetic Peptide
TPGSCGRSL

SEQ ID NO: 4104 - protein, 9 aa, Artificial Sequence
  Description of Artificial Sequence:  Synthetic Peptide
RSLDWSQVL

SEQ ID NO: 4105 - protein, 10 aa, Artificial Sequence
  Description of Artificial Sequence:  Synthetic Peptide
MPSPRQTPLY

SEQ ID NO: 4106 - protein, 10 aa, Artificial Sequence
  Description of Artificial Sequence:  Synthetic Peptide
APHGQVVCMM

SEQ ID NO: 4107 - protein, 10 aa, Artificial Sequence
  Description of Artificial Sequence:  Synthetic Peptide
GPTILMEPFL

SEQ ID NO: 4108 - protein, 10 aa, Artificial Sequence
  Description of Artificial Sequence:  Synthetic Peptide
VPCHVLLQVL

SEQ ID NO: 4109 - protein, 10 aa, Artificial Sequence
  Description of Artificial Sequence:  Synthetic Peptide
HEPEHGVEQS

SEQ ID NO: 4110 - protein, 10 aa, Artificial Sequence
  Description of Artificial Sequence:  Synthetic Peptide
VEQSSLIHWW

SEQ ID NO: 4111 - protein, 9 aa, Artificial Sequence
  Description of Artificial Sequence:  Synthetic Peptide
VEQSSLIHW

SEQ ID NO: 4112 - protein, 10 aa, Artificial Sequence
  Description of Artificial Sequence:  Synthetic Peptide
RLTRSSVEGI

SEQ ID NO: 4113 - protein, 9 aa, Artificial Sequence
  Description of Artificial Sequence:  Synthetic Peptide
GISPLMTLK

SEQ ID NO: 4114 - protein, 10 aa, Artificial Sequence
  Description of Artificial Sequence:  Synthetic Peptide
SSVEGISPLM

SEQ ID NO: 4115 - protein, 10 aa, Artificial Sequence
  Description of Artificial Sequence:  Synthetic Peptide
RSSVEGISPL

SEQ ID NO: 4116 - protein, 10 aa, Artificial Sequence
  Description of Artificial Sequence:  Synthetic Peptide
ATHPPKMLNR

SEQ ID NO: 4117 - protein, 10 aa, Artificial Sequence
  Description of Artificial Sequence:  Synthetic Peptide
KMLNRRVLWV

SEQ ID NO: 4118 - protein, 10 aa, Artificial Sequence
  Description of Artificial Sequence:  Synthetic Peptide
MLNRRVLWVV

SEQ ID NO: 4119 - protein, 10 aa, Artificial Sequence
  Description of Artificial Sequence:  Synthetic Peptide
VLWVVSGLVI

SEQ ID NO: 4120 - protein, 10 aa, Artificial Sequence
  Description of Artificial Sequence:  Synthetic Peptide
GLVIEAVNAI

SEQ ID NO: 4121 - protein, 10 aa, Artificial Sequence
  Description of Artificial Sequence:  Synthetic Peptide
ALGGASWAAT

SEQ ID NO: 4122 - protein, 10 aa, Artificial Sequence
  Description of Artificial Sequence:  Synthetic Peptide
VVSGLVIEAV

SEQ ID NO: 4123 - protein, 9 aa, Artificial Sequence
  Description of Artificial Sequence:  Synthetic Peptide
KYCIPLMKF

SEQ ID NO: 4124 - protein, 9 aa, Artificial Sequence
  Description of Artificial Sequence:  Synthetic Peptide
RVLWVVSGL

SEQ ID NO: 4125 - protein, 9 aa, Artificial Sequence
  Description of Artificial Sequence:  Synthetic Peptide
APTKAEAAL

SEQ ID NO: 4126 - protein, 9 aa, Artificial Sequence
  Description of Artificial Sequence:  Synthetic Peptide
KPAKYCIPL

SEQ ID NO: 4127 - protein, 9 aa, Artificial Sequence
  Description of Artificial Sequence:  Synthetic Peptide
AATHPPKML

SEQ ID NO: 4128 - protein, 9 aa, Artificial Sequence
  Description of Artificial Sequence:  Synthetic Peptide
RVLWVVSGL

SEQ ID NO: 4129 - protein, 9 aa, Artificial Sequence
  Description of Artificial Sequence:  Synthetic Peptide
FPRPMLPTA

SEQ ID NO: 4130 - protein, 10 aa, Artificial Sequence
  Description of Artificial Sequence:  Synthetic Peptide
KPAKYCIPLM

SEQ ID NO: 4131 - protein, 10 aa, Artificial Sequence
  Description of Artificial Sequence:  Synthetic Peptide
FPRPMLPTAA

SEQ ID NO: 4132 - protein, 10 aa, Artificial Sequence
  Description of Artificial Sequence:  Synthetic Peptide
WAATHPPKML

SEQ ID NO: 4133 - protein, 10 aa, Artificial Sequence
  Description of Artificial Sequence:  Synthetic Peptide
AQNVSRARHL

SEQ ID NO: 4134 - protein, 10 aa, Artificial Sequence
  Description of Artificial Sequence:  Synthetic Peptide
PPKMLNRRVL

SEQ ID NO: 4135 - protein, 10 aa, Artificial Sequence
  Description of Artificial Sequence:  Synthetic Peptide
KPAKYCIPLM

SEQ ID NO: 4136 - protein, 10 aa, Artificial Sequence
  Description of Artificial Sequence:  Synthetic Peptide
IPLMKFHMCF

SEQ ID NO: 4137 - protein, 10 aa, Artificial Sequence
  Description of Artificial Sequence:  Synthetic Peptide
CSASCIPCSM

SEQ ID NO: 4138 - protein, 10 aa, Artificial Sequence
  Description of Artificial Sequence:  Synthetic Peptide
MSTSTFPRPM

SEQ ID NO: 4139 - protein, 9 aa, Artificial Sequence
  Description of Artificial Sequence:  Synthetic Peptide
KPAKYCIPL

SEQ ID NO: 4140 - protein, 9 aa, Artificial Sequence
  Description of Artificial Sequence:  Synthetic Peptide
APTKAEAAL

SEQ ID NO: 4141 - protein, 9 aa, Artificial Sequence
  Description of Artificial Sequence:  Synthetic Peptide
AEAALGGAS

SEQ ID NO: 4142 - protein, 10 aa, Artificial Sequence
  Description of Artificial Sequence:  Synthetic Peptide
AEAALGGASW

SEQ ID NO: 4143 - protein, 10 aa, Artificial Sequence
  Description of Artificial Sequence:  Synthetic Peptide
IEAVNAINDA

SEQ ID NO: 4144 - protein, 9 aa, Artificial Sequence
  Description of Artificial Sequence:  Synthetic Peptide
SADMHAMMY

SEQ ID NO: 4145 - protein, 9 aa, Artificial Sequence
  Description of Artificial Sequence:  Synthetic Peptide
TTLPVVRQY

SEQ ID NO: 4146 - protein, 9 aa, Artificial Sequence
  Description of Artificial Sequence:  Synthetic Peptide
WTAPSLYSK

SEQ ID NO: 4147 - protein, 10 aa, Artificial Sequence
  Description of Artificial Sequence:  Synthetic Peptide
AMMYLVMGWV

SEQ ID NO: 4148 - protein, 9 aa, Artificial Sequence
  Description of Artificial Sequence:  Synthetic Peptide
YLVMGWVRV

SEQ ID NO: 4149 - protein, 9 aa, Artificial Sequence
  Description of Artificial Sequence:  Synthetic Peptide
MMYLVMGWV

SEQ ID NO: 4150 - protein, 9 aa, Artificial Sequence
  Description of Artificial Sequence:  Synthetic Peptide
TLPVVRQYA

SEQ ID NO: 4151 - protein, 10 aa, Artificial Sequence
  Description of Artificial Sequence:  Synthetic Peptide
RTPPTSTQVL

SEQ ID NO: 4152 - protein, 10 aa, Artificial Sequence
  Description of Artificial Sequence:  Synthetic Peptide
MMYLVMGWVR

SEQ ID NO: 4153 - protein, 9 aa, Artificial Sequence
  Description of Artificial Sequence:  Synthetic Peptide
TPPTSTQVL

SEQ ID NO: 4154 - protein, 9 aa, Artificial Sequence
  Description of Artificial Sequence:  Synthetic Peptide
AARTPPTST

SEQ ID NO: 4155 - protein, 9 aa, Artificial Sequence
  Description of Artificial Sequence:  Synthetic Peptide
APSLYSKGV

SEQ ID NO: 4156 - protein, 10 aa, Artificial Sequence
  Description of Artificial Sequence:  Synthetic Peptide
GPCSVGFSRM

SEQ ID NO: 4157 - protein, 10 aa, Artificial Sequence
  Description of Artificial Sequence:  Synthetic Peptide
TSRSADMHAM

SEQ ID NO: 4158 - protein, 9 aa, Artificial Sequence
  Description of Artificial Sequence:  Synthetic Peptide
FSRMRHFHI

SEQ ID NO: 4159 - protein, 10 aa, Artificial Sequence
  Description of Artificial Sequence:  Synthetic Peptide
AARAARTPPT

SEQ ID NO: 4160 - protein, 10 aa, Artificial Sequence
  Description of Artificial Sequence:  Synthetic Peptide
TSRSADMHAM

SEQ ID NO: 4161 - protein, 10 aa, Artificial Sequence
  Description of Artificial Sequence:  Synthetic Peptide
RSADMHAMMY

SEQ ID NO: 4162 - protein, 10 aa, Artificial Sequence
  Description of Artificial Sequence:  Synthetic Peptide
GPCSVGFSRM

SEQ ID NO: 4163 - protein, 10 aa, Artificial Sequence
  Description of Artificial Sequence:  Synthetic Peptide
TSFWTAPSLY

SEQ ID NO: 4164 - protein, 9 aa, Artificial Sequence
  Description of Artificial Sequence:  Synthetic Peptide
RSADMHAMM

SEQ ID NO: 4165 - protein, 9 aa, Artificial Sequence
  Description of Artificial Sequence:  Synthetic Peptide
TPPTSTQVL

SEQ ID NO: 4166 - protein, 9 aa, Artificial Sequence
  Description of Artificial Sequence:  Synthetic Peptide
TTLPVVRQY

SEQ ID NO: 4167 - protein, 10 aa, Artificial Sequence
  Description of Artificial Sequence:  Synthetic Peptide
MTTLPVVRQY

SEQ ID NO: 4168 - protein, 10 aa, Artificial Sequence
  Description of Artificial Sequence:  Synthetic Peptide
WSWQTGNPGV

SEQ ID NO: 4169 - protein, 10 aa, Artificial Sequence
  Description of Artificial Sequence:  Synthetic Peptide
EGRSPGVTNL

SEQ ID NO: 4170 - protein, 9 aa, Artificial Sequence
  Description of Artificial Sequence:  Synthetic Peptide
LLPLPVLPR

SEQ ID NO: 4171 - protein, 10 aa, Artificial Sequence
  Description of Artificial Sequence:  Synthetic Peptide
LPRRCERDTA

SEQ ID NO: 4172 - protein, 9 aa, Artificial Sequence
  Description of Artificial Sequence:  Synthetic Peptide
MPLLPLPVL

SEQ ID NO: 4173 - protein, 9 aa, Artificial Sequence
  Description of Artificial Sequence:  Synthetic Peptide
LPRRCERDT

SEQ ID NO: 4174 - protein, 9 aa, Artificial Sequence
  Description of Artificial Sequence:  Synthetic Peptide
MPLLPLPVL

SEQ ID NO: 4175 - protein, 10 aa, Artificial Sequence
  Description of Artificial Sequence:  Synthetic Peptide
KVGSKLKSTV

SEQ ID NO: 4176 - protein, 9 aa, Artificial Sequence
  Description of Artificial Sequence:  Synthetic Peptide
SITESKSPV

SEQ ID NO: 4177 - protein, 10 aa, Artificial Sequence
  Description of Artificial Sequence:  Synthetic Peptide
KSTVWVTHVL

SEQ ID NO: 4178 - protein, 9 aa, Artificial Sequence
  Description of Artificial Sequence:  Synthetic Peptide
VLQSITESK

SEQ ID NO: 4179 - protein, 10 aa, Artificial Sequence
  Description of Artificial Sequence:  Synthetic Peptide
KSTVWVTHVL

SEQ ID NO: 4180 - protein, 9 aa, Artificial Sequence
  Description of Artificial Sequence:  Synthetic Peptide
LMASMGMAL

SEQ ID NO: 4181 - protein, 9 aa, Artificial Sequence
  Description of Artificial Sequence:  Synthetic Peptide
CLPPLMASM

SEQ ID NO: 4182 - protein, 10 aa, Artificial Sequence
  Description of Artificial Sequence:  Synthetic Peptide
LPPLMASMGM

SEQ ID NO: 4183 - protein, 10 aa, Artificial Sequence
  Description of Artificial Sequence:  Synthetic Peptide
LPPLMASMGM

SEQ ID NO: 4184 - protein, 9 aa, Artificial Sequence
  Description of Artificial Sequence:  Synthetic Peptide
VTDPGGVAV

SEQ ID NO: 4185 - protein, 10 aa, Artificial Sequence
  Description of Artificial Sequence:  Synthetic Peptide
VTDPGGVAVA

SEQ ID NO: 4186 - protein, 10 aa, Artificial Sequence
  Description of Artificial Sequence:  Synthetic Peptide
TVTDPGGVAV

SEQ ID NO: 4187 - protein, 9 aa, Artificial Sequence
  Description of Artificial Sequence:  Synthetic Peptide
MPKIVVESV

SEQ ID NO: 4188 - protein, 10 aa, Artificial Sequence
  Description of Artificial Sequence:  Synthetic Peptide
VSAWSRTVPM

SEQ ID NO: 4189 - protein, 10 aa, Artificial Sequence
  Description of Artificial Sequence:  Synthetic Peptide
ALDIYAPNPK

SEQ ID NO: 4190 - protein, 10 aa, Artificial Sequence
  Description of Artificial Sequence:  Synthetic Peptide
LMLGSIPCAL

SEQ ID NO: 4191 - protein, 10 aa, Artificial Sequence
  Description of Artificial Sequence:  Synthetic Peptide
VLMLGSIPCA

SEQ ID NO: 4192 - protein, 10 aa, Artificial Sequence
  Description of Artificial Sequence:  Synthetic Peptide
TLYPWAAYAA

SEQ ID NO: 4193 - protein, 9 aa, Artificial Sequence
  Description of Artificial Sequence:  Synthetic Peptide
TLYPWAAYA

SEQ ID NO: 4194 - protein, 9 aa, Artificial Sequence
  Description of Artificial Sequence:  Synthetic Peptide
TLVLLPLPV

SEQ ID NO: 4195 - protein, 9 aa, Artificial Sequence
  Description of Artificial Sequence:  Synthetic Peptide
LMLGSIPCA

SEQ ID NO: 4196 - protein, 9 aa, Artificial Sequence
  Description of Artificial Sequence:  Synthetic Peptide
MLGSIPCAL

SEQ ID NO: 4197 - protein, 9 aa, Artificial Sequence
  Description of Artificial Sequence:  Synthetic Peptide
VLLPLPVGA

SEQ ID NO: 4198 - protein, 9 aa, Artificial Sequence
  Description of Artificial Sequence:  Synthetic Peptide
VLMLGSIPC

SEQ ID NO: 4199 - protein, 9 aa, Artificial Sequence
  Description of Artificial Sequence:  Synthetic Peptide
MVLTPVLML

SEQ ID NO: 4200 - protein, 9 aa, Artificial Sequence
  Description of Artificial Sequence:  Synthetic Peptide
AYAAGTLVL

SEQ ID NO: 4201 - protein, 10 aa, Artificial Sequence
  Description of Artificial Sequence:  Synthetic Peptide
AYAAGTLVLL

SEQ ID NO: 4202 - protein, 10 aa, Artificial Sequence
  Description of Artificial Sequence:  Synthetic Peptide
ALDIYAPNPK

SEQ ID NO: 4203 - protein, 9 aa, Artificial Sequence
  Description of Artificial Sequence:  Synthetic Peptide
MVLTPVLML

SEQ ID NO: 4204 - protein, 9 aa, Artificial Sequence
  Description of Artificial Sequence:  Synthetic Peptide
YAAGTLVLL

SEQ ID NO: 4205 - protein, 9 aa, Artificial Sequence
  Description of Artificial Sequence:  Synthetic Peptide
AGTLVLLPL

SEQ ID NO: 4206 - protein, 9 aa, Artificial Sequence
  Description of Artificial Sequence:  Synthetic Peptide
WAAYAAGTL

SEQ ID NO: 4207 - protein, 10 aa, Artificial Sequence
  Description of Artificial Sequence:  Synthetic Peptide
NPKVAATDGL

SEQ ID NO: 4208 - protein, 10 aa, Artificial Sequence
  Description of Artificial Sequence:  Synthetic Peptide
NPKVAATDGL

SEQ ID NO: 4209 - protein, 10 aa, Artificial Sequence
  Description of Artificial Sequence:  Synthetic Peptide
LPLPVGACRW

SEQ ID NO: 4210 - protein, 10 aa, Artificial Sequence
  Description of Artificial Sequence:  Synthetic Peptide
GSIPCALDIY

SEQ ID NO: 4211 - protein, 10 aa, Artificial Sequence
  Description of Artificial Sequence:  Synthetic Peptide
TSTLYPWAAY

SEQ ID NO: 4212 - protein, 10 aa, Artificial Sequence
  Description of Artificial Sequence:  Synthetic Peptide
GSIPCALDIY

SEQ ID NO: 4213 - protein, 10 aa, Artificial Sequence
  Description of Artificial Sequence:  Synthetic Peptide
TDGLRTSTLY

SEQ ID NO: 4214 - protein, 9 aa, Artificial Sequence
  Description of Artificial Sequence:  Synthetic Peptide
DGLRTSTLY

SEQ ID NO: 4215 - protein, 9 aa, Artificial Sequence
  Description of Artificial Sequence:  Synthetic Peptide
STLYPWAAY

SEQ ID NO: 4216 - protein, 10 aa, Artificial Sequence
  Description of Artificial Sequence:  Synthetic Peptide
DSTGTKSTAF

SEQ ID NO: 4217 - protein, 9 aa, Artificial Sequence
  Description of Artificial Sequence:  Synthetic Peptide
MMQPSRPRV

SEQ ID NO: 4218 - protein, 9 aa, Artificial Sequence
  Description of Artificial Sequence:  Synthetic Peptide
QPSRPRVCW

SEQ ID NO: 4219 - protein, 9 aa, Artificial Sequence
  Description of Artificial Sequence:  Synthetic Peptide
KMMSPHAAV

SEQ ID NO: 4220 - protein, 9 aa, Artificial Sequence
  Description of Artificial Sequence:  Synthetic Peptide
GPRSISFPL

SEQ ID NO: 4221 - protein, 9 aa, Artificial Sequence
  Description of Artificial Sequence:  Synthetic Peptide
QSRSGVRWL

SEQ ID NO: 4222 - protein, 9 aa, Artificial Sequence
  Description of Artificial Sequence:  Synthetic Peptide
HPRPSRLSA

SEQ ID NO: 4223 - protein, 9 aa, Artificial Sequence
  Description of Artificial Sequence:  Synthetic Peptide
GPRSISFPL

SEQ ID NO: 4224 - protein, 9 aa, Artificial Sequence
  Description of Artificial Sequence:  Synthetic Peptide
GPRSISFPL

SEQ ID NO: 4225 - protein, 9 aa, Artificial Sequence
  Description of Artificial Sequence:  Synthetic Peptide
QSRSGVRWL

SEQ ID NO: 4226 - protein, 9 aa, Artificial Sequence
  Description of Artificial Sequence:  Synthetic Peptide
RPKMMSPHA

SEQ ID NO: 4227 - protein, 9 aa, Artificial Sequence
  Description of Artificial Sequence:  Synthetic Peptide
AETGRPKMM

SEQ ID NO: 4228 - protein, 10 aa, Artificial Sequence
  Description of Artificial Sequence:  Synthetic Peptide
ILVSMSEKTT

SEQ ID NO: 4229 - protein, 10 aa, Artificial Sequence
  Description of Artificial Sequence:  Synthetic Peptide
VMILVSMSEK

SEQ ID NO: 4230 - protein, 10 aa, Artificial Sequence
  Description of Artificial Sequence:  Synthetic Peptide
AVSAPQVMIL

SEQ ID NO: 4231 - protein, 10 aa, Artificial Sequence
  Description of Artificial Sequence:  Synthetic Peptide
APQVMILVSM

SEQ ID NO: 4232 - protein, 10 aa, Artificial Sequence
  Description of Artificial Sequence:  Synthetic Peptide
RSRHPRPSRL

SEQ ID NO: 4233 - protein, 10 aa, Artificial Sequence
  Description of Artificial Sequence:  Synthetic Peptide
AQSRSGVRWL

SEQ ID NO: 4234 - protein, 10 aa, Artificial Sequence
  Description of Artificial Sequence:  Synthetic Peptide
AGPRSISFPL

SEQ ID NO: 4235 - protein, 10 aa, Artificial Sequence
  Description of Artificial Sequence:  Synthetic Peptide
RSRHPRPSRL

SEQ ID NO: 4236 - protein, 10 aa, Artificial Sequence
  Description of Artificial Sequence:  Synthetic Peptide
TARSRRPAWA

SEQ ID NO: 4237 - protein, 10 aa, Artificial Sequence
  Description of Artificial Sequence:  Synthetic Peptide
APQVMILVSM

SEQ ID NO: 4238 - protein, 10 aa, Artificial Sequence
  Description of Artificial Sequence:  Synthetic Peptide
RSRHPRPSRL

SEQ ID NO: 4239 - protein, 10 aa, Artificial Sequence
  Description of Artificial Sequence:  Synthetic Peptide
RPKMMSPHAA

SEQ ID NO: 4240 - protein, 10 aa, Artificial Sequence
  Description of Artificial Sequence:  Synthetic Peptide
AETGRPKMMS

SEQ ID NO: 4241 - protein, 10 aa, Artificial Sequence
  Description of Artificial Sequence:  Synthetic Peptide
SEKTTGSTAT

SEQ ID NO: 4242 - protein, 9 aa, Artificial Sequence
  Description of Artificial Sequence:  Synthetic Peptide
MYVPVSAPS

SEQ ID NO: 4243 - protein, 9 aa, Artificial Sequence
  Description of Artificial Sequence:  Synthetic Peptide
VPVSAPSFM

SEQ ID NO: 4244 - protein, 9 aa, Artificial Sequence
  Description of Artificial Sequence:  Synthetic Peptide
VPVSAPSFM

SEQ ID NO: 4245 - protein, 9 aa, Artificial Sequence
  Description of Artificial Sequence:  Synthetic Peptide
APSFMKAIW

SEQ ID NO: 4246 - protein, 10 aa, Artificial Sequence
  Description of Artificial Sequence:  Synthetic Peptide
YVPVSAPSFM

SEQ ID NO: 4247 - protein, 10 aa, Artificial Sequence
  Description of Artificial Sequence:  Synthetic Peptide
MYVPVSAPSF

SEQ ID NO: 4248 - protein, 9 aa, Artificial Sequence
  Description of Artificial Sequence:  Synthetic Peptide
KYCNHHMSL

SEQ ID NO: 4249 - protein, 9 aa, Artificial Sequence
  Description of Artificial Sequence:  Synthetic Peptide
GPSMASRSL

SEQ ID NO: 4250 - protein, 9 aa, Artificial Sequence
  Description of Artificial Sequence:  Synthetic Peptide
MASRPPRTL

SEQ ID NO: 4251 - protein, 9 aa, Artificial Sequence
  Description of Artificial Sequence:  Synthetic Peptide
GPSMASRSL

SEQ ID NO: 4252 - protein, 9 aa, Artificial Sequence
  Description of Artificial Sequence:  Synthetic Peptide
WSTMSGPSM

SEQ ID NO: 4253 - protein, 9 aa, Artificial Sequence
  Description of Artificial Sequence:  Synthetic Peptide
CASALVIKY

SEQ ID NO: 4254 - protein, 10 aa, Artificial Sequence
  Description of Artificial Sequence:  Synthetic Peptide
KISSGWTAHV

SEQ ID NO: 4255 - protein, 10 aa, Artificial Sequence
  Description of Artificial Sequence:  Synthetic Peptide
RMMASRPPRT

SEQ ID NO: 4256 - protein, 10 aa, Artificial Sequence
  Description of Artificial Sequence:  Synthetic Peptide
KYCNHHMSLA

SEQ ID NO: 4257 - protein, 10 aa, Artificial Sequence
  Description of Artificial Sequence:  Synthetic Peptide
TLRGGTHTCK

SEQ ID NO: 4258 - protein, 10 aa, Artificial Sequence
  Description of Artificial Sequence:  Synthetic Peptide
ASRSLVMSKI

SEQ ID NO: 4259 - protein, 10 aa, Artificial Sequence
  Description of Artificial Sequence:  Synthetic Peptide
KCASALVIKY

SEQ ID NO: 4260 - protein, 9 aa, Artificial Sequence
  Description of Artificial Sequence:  Synthetic Peptide
TTDPTPYRY

SEQ ID NO: 4261 - protein, 9 aa, Artificial Sequence
  Description of Artificial Sequence:  Synthetic Peptide
ALRTTRFSK

SEQ ID NO: 4262 - protein, 9 aa, Artificial Sequence
  Description of Artificial Sequence:  Synthetic Peptide
CAPATDAAL

SEQ ID NO: 4263 - protein, 9 aa, Artificial Sequence
  Description of Artificial Sequence:  Synthetic Peptide
KSSRTYSHL

SEQ ID NO: 4264 - protein, 9 aa, Artificial Sequence
  Description of Artificial Sequence:  Synthetic Peptide
DAALRTTRF

SEQ ID NO: 4265 - protein, 10 aa, Artificial Sequence
  Description of Artificial Sequence:  Synthetic Peptide
TTDPTPYRYC

SEQ ID NO: 4266 - protein, 10 aa, Artificial Sequence
  Description of Artificial Sequence:  Synthetic Peptide
ATDAALRTTR

SEQ ID NO: 4267 - protein, 10 aa, Artificial Sequence
  Description of Artificial Sequence:  Synthetic Peptide
ALRTTRFSKV

SEQ ID NO: 4268 - protein, 10 aa, Artificial Sequence
  Description of Artificial Sequence:  Synthetic Peptide
PYRYCTSTIF

SEQ ID NO: 4269 - protein, 10 aa, Artificial Sequence
  Description of Artificial Sequence:  Synthetic Peptide
ALRTTRFSKV

SEQ ID NO: 4270 - protein, 10 aa, Artificial Sequence
  Description of Artificial Sequence:  Synthetic Peptide
SARRRKSSRT

SEQ ID NO: 4271 - protein, 10 aa, Artificial Sequence
  Description of Artificial Sequence:  Synthetic Peptide
TETTTDPTPY

SEQ ID NO: 4272 - protein, 10 aa, Artificial Sequence
  Description of Artificial Sequence:  Synthetic Peptide
TDAALRTTRF

SEQ ID NO: 4273 - protein, 9 aa, Artificial Sequence
  Description of Artificial Sequence:  Synthetic Peptide
VLLSSSTSV

SEQ ID NO: 4274 - protein, 9 aa, Artificial Sequence
  Description of Artificial Sequence:  Synthetic Peptide
VLVNPVLFI

SEQ ID NO: 4275 - protein, 9 aa, Artificial Sequence
  Description of Artificial Sequence:  Synthetic Peptide
MLHGGPPHV

SEQ ID NO: 4276 - protein, 9 aa, Artificial Sequence
  Description of Artificial Sequence:  Synthetic Peptide
VSFSPQLYV

SEQ ID NO: 4277 - protein, 9 aa, Artificial Sequence
  Description of Artificial Sequence:  Synthetic Peptide
FIHVQPNQL

SEQ ID NO: 4278 - protein, 9 aa, Artificial Sequence
  Description of Artificial Sequence:  Synthetic Peptide
QLYVGTPER

SEQ ID NO: 4279 - protein, 9 aa, Artificial Sequence
  Description of Artificial Sequence:  Synthetic Peptide
LPCGGRVLL

SEQ ID NO: 4280 - protein, 9 aa, Artificial Sequence
  Description of Artificial Sequence:  Synthetic Peptide
SVVPTTTGL

SEQ ID NO: 4281 - protein, 9 aa, Artificial Sequence
  Description of Artificial Sequence:  Synthetic Peptide
LPCGGRVLL

SEQ ID NO: 4282 - protein, 9 aa, Artificial Sequence
  Description of Artificial Sequence:  Synthetic Peptide
TTGLGVKQY

SEQ ID NO: 4283 - protein, 10 aa, Artificial Sequence
  Description of Artificial Sequence:  Synthetic Peptide
SVSFSPQLYV

SEQ ID NO: 4284 - protein, 10 aa, Artificial Sequence
  Description of Artificial Sequence:  Synthetic Peptide
RVLLSSSTSV

SEQ ID NO: 4285 - protein, 10 aa, Artificial Sequence
  Description of Artificial Sequence:  Synthetic Peptide
QLPCGGRVLL

SEQ ID NO: 4286 - protein, 10 aa, Artificial Sequence
  Description of Artificial Sequence:  Synthetic Peptide
LVNPVLFIHV

SEQ ID NO: 4287 - protein, 10 aa, Artificial Sequence
  Description of Artificial Sequence:  Synthetic Peptide
MLHGGPPHVL

SEQ ID NO: 4288 - protein, 10 aa, Artificial Sequence
  Description of Artificial Sequence:  Synthetic Peptide
YVGTPERSVV

SEQ ID NO: 4289 - protein, 10 aa, Artificial Sequence
  Description of Artificial Sequence:  Synthetic Peptide
VVPTTTGLGV

SEQ ID NO: 4290 - protein, 10 aa, Artificial Sequence
  Description of Artificial Sequence:  Synthetic Peptide
LFIHVQPNQL

SEQ ID NO: 4291 - protein, 10 aa, Artificial Sequence
  Description of Artificial Sequence:  Synthetic Peptide
RSVVPTTTGL

SEQ ID NO: 4292 - protein, 10 aa, Artificial Sequence
  Description of Artificial Sequence:  Synthetic Peptide
GPHTCDAGTI

SEQ ID NO: 4293 - protein, 10 aa, Artificial Sequence
  Description of Artificial Sequence:  Synthetic Peptide
RSVVPTTTGL

SEQ ID NO: 4294 - protein, 10 aa, Artificial Sequence
  Description of Artificial Sequence:  Synthetic Peptide
TSVSFSPQLY

SEQ ID NO: 4295 - protein, 10 aa, Artificial Sequence
  Description of Artificial Sequence:  Synthetic Peptide
TTTGLGVKQY

SEQ ID NO: 4296 - protein, 10 aa, Artificial Sequence
  Description of Artificial Sequence:  Synthetic Peptide
AMRSGHPDAL

SEQ ID NO: 4297 - protein, 10 aa, Artificial Sequence
  Description of Artificial Sequence:  Synthetic Peptide
RSGHPDALNL

SEQ ID NO: 4298 - protein, 9 aa, Artificial Sequence
  Description of Artificial Sequence:  Synthetic Peptide
LLMCQLPLV

SEQ ID NO: 4299 - protein, 9 aa, Artificial Sequence
  Description of Artificial Sequence:  Synthetic Peptide
VLLMCQLPL

SEQ ID NO: 4300 - protein, 9 aa, Artificial Sequence
  Description of Artificial Sequence:  Synthetic Peptide
SLQFRAVLL

SEQ ID NO: 4301 - protein, 9 aa, Artificial Sequence
  Description of Artificial Sequence:  Synthetic Peptide
RAVLLMCQL

SEQ ID NO: 4302 - protein, 9 aa, Artificial Sequence
  Description of Artificial Sequence:  Synthetic Peptide
RAVLLMCQL

SEQ ID NO: 4303 - protein, 10 aa, Artificial Sequence
  Description of Artificial Sequence:  Synthetic Peptide
VLLMCQLPLV

SEQ ID NO: 4304 - protein, 10 aa, Artificial Sequence
  Description of Artificial Sequence:  Synthetic Peptide
QLPLVFTSWI

SEQ ID NO: 4305 - protein, 10 aa, Artificial Sequence
  Description of Artificial Sequence:  Synthetic Peptide
LMCQLPLVFT

SEQ ID NO: 4306 - protein, 10 aa, Artificial Sequence
  Description of Artificial Sequence:  Synthetic Peptide
SLQFRAVLLM

SEQ ID NO: 4307 - protein, 10 aa, Artificial Sequence
  Description of Artificial Sequence:  Synthetic Peptide
AVLLMCQLPL

SEQ ID NO: 4308 - protein, 10 aa, Artificial Sequence
  Description of Artificial Sequence:  Synthetic Peptide
NPVWRESLQF

SEQ ID NO: 4309 - protein, 10 aa, Artificial Sequence
  Description of Artificial Sequence:  Synthetic Peptide
LPLVFTSWIF

SEQ ID NO: 4310 - protein, 9 aa, Artificial Sequence
  Description of Artificial Sequence:  Synthetic Peptide
MLLFLAASV

SEQ ID NO: 4311 - protein, 9 aa, Artificial Sequence
  Description of Artificial Sequence:  Synthetic Peptide
KLLSRTQGT

SEQ ID NO: 4312 - protein, 9 aa, Artificial Sequence
  Description of Artificial Sequence:  Synthetic Peptide
ILELEQSFV

SEQ ID NO: 4313 - protein, 9 aa, Artificial Sequence
  Description of Artificial Sequence:  Synthetic Peptide
MIMSAASYT

SEQ ID NO: 4314 - protein, 9 aa, Artificial Sequence
  Description of Artificial Sequence:  Synthetic Peptide
IMSAASYTI

SEQ ID NO: 4315 - protein, 9 aa, Artificial Sequence
  Description of Artificial Sequence:  Synthetic Peptide
AASYTILEL

SEQ ID NO: 4316 - protein, 9 aa, Artificial Sequence
  Description of Artificial Sequence:  Synthetic Peptide
SATQQREKL

SEQ ID NO: 4317 - protein, 9 aa, Artificial Sequence
  Description of Artificial Sequence:  Synthetic Peptide
ATQQREKLL

SEQ ID NO: 4318 - protein, 9 aa, Artificial Sequence
  Description of Artificial Sequence:  Synthetic Peptide
LEQSFVTWY

SEQ ID NO: 4319 - protein, 9 aa, Artificial Sequence
  Description of Artificial Sequence:  Synthetic Peptide
LELEQSFVT

SEQ ID NO: 4320 - protein, 10 aa, Artificial Sequence
  Description of Artificial Sequence:  Synthetic Peptide
ELEQSFVTWY

SEQ ID NO: 4321 - protein, 10 aa, Artificial Sequence
  Description of Artificial Sequence:  Synthetic Peptide
TILELEQSFV

SEQ ID NO: 4322 - protein, 10 aa, Artificial Sequence
  Description of Artificial Sequence:  Synthetic Peptide
LLFLAASVGV

SEQ ID NO: 4323 - protein, 10 aa, Artificial Sequence
  Description of Artificial Sequence:  Synthetic Peptide
CMIMSAASYT

SEQ ID NO: 4324 - protein, 10 aa, Artificial Sequence
  Description of Artificial Sequence:  Synthetic Peptide
FLAASVGVSA

SEQ ID NO: 4325 - protein, 10 aa, Artificial Sequence
  Description of Artificial Sequence:  Synthetic Peptide
IMSAASYTIL

SEQ ID NO: 4326 - protein, 10 aa, Artificial Sequence
  Description of Artificial Sequence:  Synthetic Peptide
LEQSFVTWYI

SEQ ID NO: 4327 - protein, 10 aa, Artificial Sequence
  Description of Artificial Sequence:  Synthetic Peptide
ELEQSFVTWY

SEQ ID NO: 4328 - protein, 10 aa, Artificial Sequence
  Description of Artificial Sequence:  Synthetic Peptide
FVTWYIPDTL

SEQ ID NO: 4329 - protein, 10 aa, Artificial Sequence
  Description of Artificial Sequence:  Synthetic Peptide
SATQQREKLL

SEQ ID NO: 4330 - protein, 10 aa, Artificial Sequence
  Description of Artificial Sequence:  Synthetic Peptide
SAASYTILEL

SEQ ID NO: 4331 - protein, 10 aa, Artificial Sequence
  Description of Artificial Sequence:  Synthetic Peptide
SATQQREKLL

SEQ ID NO: 4332 - protein, 10 aa, Artificial Sequence
  Description of Artificial Sequence:  Synthetic Peptide
LELEQSFVTW

SEQ ID NO: 4333 - protein, 10 aa, Artificial Sequence
  Description of Artificial Sequence:  Synthetic Peptide
VCMIMSAASY

SEQ ID NO: 4334 - protein, 9 aa, Artificial Sequence
  Description of Artificial Sequence:  Synthetic Peptide
KEQPGRFPV

SEQ ID NO: 4335 - protein, 9 aa, Artificial Sequence
  Description of Artificial Sequence:  Synthetic Peptide
IEKEQPGRF

SEQ ID NO: 4336 - protein, 9 aa, Artificial Sequence
  Description of Artificial Sequence:  Synthetic Peptide
KEQPGRFPV

SEQ ID NO: 4337 - protein, 9 aa, Artificial Sequence
  Description of Artificial Sequence:  Synthetic Peptide
HPAHPIPSL

SEQ ID NO: 4338 - protein, 9 aa, Artificial Sequence
  Description of Artificial Sequence:  Synthetic Peptide
RVSMTLPKL

SEQ ID NO: 4339 - protein, 9 aa, Artificial Sequence
  Description of Artificial Sequence:  Synthetic Peptide
HPAHPIPSL

SEQ ID NO: 4340 - protein, 10 aa, Artificial Sequence
  Description of Artificial Sequence:  Synthetic Peptide
KPHVRVSMTL

SEQ ID NO: 4341 - protein, 10 aa, Artificial Sequence
  Description of Artificial Sequence:  Synthetic Peptide
KPHVRVSMTL

SEQ ID NO: 4342 - protein, 10 aa, Artificial Sequence
  Description of Artificial Sequence:  Synthetic Peptide
EPRGDRSHPA

SEQ ID NO: 4343 - protein, 10 aa, Artificial Sequence
  Description of Artificial Sequence:  Synthetic Peptide
YPMRSAKPHV

SEQ ID NO: 4344 - protein, 10 aa, Artificial Sequence
  Description of Artificial Sequence:  Synthetic Peptide
EPRGDRSHPA

SEQ ID NO: 4345 - protein, 10 aa, Artificial Sequence
  Description of Artificial Sequence:  Synthetic Peptide
KLRDLRRGSV

SEQ ID NO: 4346 - protein, 10 aa, Artificial Sequence
  Description of Artificial Sequence:  Synthetic Peptide
KPHVRVSMTL

SEQ ID NO: 4347 - protein, 10 aa, Artificial Sequence
  Description of Artificial Sequence:  Synthetic Peptide
SAKPHVRVSM

SEQ ID NO: 4348 - protein, 9 aa, Artificial Sequence
  Description of Artificial Sequence:  Synthetic Peptide
PYQAVPQGL

SEQ ID NO: 4349 - protein, 9 aa, Artificial Sequence
  Description of Artificial Sequence:  Synthetic Peptide
GLSRPNTTR

SEQ ID NO: 4350 - protein, 9 aa, Artificial Sequence
  Description of Artificial Sequence:  Synthetic Peptide
LSRPNTTRL

SEQ ID NO: 4351 - protein, 9 aa, Artificial Sequence
  Description of Artificial Sequence:  Synthetic Peptide
LPGHSQAPY

SEQ ID NO: 4352 - protein, 9 aa, Artificial Sequence
  Description of Artificial Sequence:  Synthetic Peptide
LSRPNTTRL

SEQ ID NO: 4353 - protein, 10 aa, Artificial Sequence
  Description of Artificial Sequence:  Synthetic Peptide
GLSRPNTTRL

SEQ ID NO: 4354 - protein, 10 aa, Artificial Sequence
  Description of Artificial Sequence:  Synthetic Peptide
APYQAVPQGL

SEQ ID NO: 4355 - protein, 10 aa, Artificial Sequence
  Description of Artificial Sequence:  Synthetic Peptide
APYQAVPQGL

SEQ ID NO: 4356 - protein, 9 aa, Artificial Sequence
  Description of Artificial Sequence:  Synthetic Peptide
QVDAYPYRK

SEQ ID NO: 4357 - protein, 9 aa, Artificial Sequence
  Description of Artificial Sequence:  Synthetic Peptide
RLTDLSQLA

SEQ ID NO: 4358 - protein, 9 aa, Artificial Sequence
  Description of Artificial Sequence:  Synthetic Peptide
KWPIGLECL

SEQ ID NO: 4359 - protein, 9 aa, Artificial Sequence
  Description of Artificial Sequence:  Synthetic Peptide
QVDAYPYRK

SEQ ID NO: 4360 - protein, 9 aa, Artificial Sequence
  Description of Artificial Sequence:  Synthetic Peptide
KNRKWPIGL

SEQ ID NO: 4361 - protein, 9 aa, Artificial Sequence
  Description of Artificial Sequence:  Synthetic Peptide
GEQVDAYPY

SEQ ID NO: 4362 - protein, 10 aa, Artificial Sequence
  Description of Artificial Sequence:  Synthetic Peptide
VGEQVDAYPY

SEQ ID NO: 4363 - protein, 10 aa, Artificial Sequence
  Description of Artificial Sequence:  Synthetic Peptide
RLTDLSQLAV

SEQ ID NO: 4364 - protein, 10 aa, Artificial Sequence
  Description of Artificial Sequence:  Synthetic Peptide
APRSSVGEQV

SEQ ID NO: 4365 - protein, 10 aa, Artificial Sequence
  Description of Artificial Sequence:  Synthetic Peptide
VTRAKMEPPL

SEQ ID NO: 4366 - protein, 10 aa, Artificial Sequence
  Description of Artificial Sequence:  Synthetic Peptide
APRSSVGEQV

SEQ ID NO: 4367 - protein, 10 aa, Artificial Sequence
  Description of Artificial Sequence:  Synthetic Peptide
SSVGEQVDAY

SEQ ID NO: 4368 - protein, 10 aa, Artificial Sequence
  Description of Artificial Sequence:  Synthetic Peptide
SSVGEQVDAY

SEQ ID NO: 4369 - protein, 9 aa, Artificial Sequence
  Description of Artificial Sequence:  Synthetic Peptide
MSPDSQGWY

SEQ ID NO: 4370 - protein, 9 aa, Artificial Sequence
  Description of Artificial Sequence:  Synthetic Peptide
WGRQLAGFL

SEQ ID NO: 4371 - protein, 9 aa, Artificial Sequence
  Description of Artificial Sequence:  Synthetic Peptide
VAQRVDGQL

SEQ ID NO: 4372 - protein, 10 aa, Artificial Sequence
  Description of Artificial Sequence:  Synthetic Peptide
RVDGQLAFLR

SEQ ID NO: 4373 - protein, 10 aa, Artificial Sequence
  Description of Artificial Sequence:  Synthetic Peptide
RVAQRVDGQL

SEQ ID NO: 4374 - protein, 10 aa, Artificial Sequence
  Description of Artificial Sequence:  Synthetic Peptide
RVAQRVDGQL

SEQ ID NO: 4375 - protein, 9 aa, Artificial Sequence
  Description of Artificial Sequence:  Synthetic Peptide
RLQGRRRQL

SEQ ID NO: 4376 - protein, 9 aa, Artificial Sequence
  Description of Artificial Sequence:  Synthetic Peptide
TVFDMSGDL

SEQ ID NO: 4377 - protein, 9 aa, Artificial Sequence
  Description of Artificial Sequence:  Synthetic Peptide
DPHGTVFDM

SEQ ID NO: 4378 - protein, 9 aa, Artificial Sequence
  Description of Artificial Sequence:  Synthetic Peptide
DAVSPPDSL

SEQ ID NO: 4379 - protein, 9 aa, Artificial Sequence
  Description of Artificial Sequence:  Synthetic Peptide
DPHGTVFDM

SEQ ID NO: 4380 - protein, 10 aa, Artificial Sequence
  Description of Artificial Sequence:  Synthetic Peptide
SPPDSLVPAL

SEQ ID NO: 4381 - protein, 10 aa, Artificial Sequence
  Description of Artificial Sequence:  Synthetic Peptide
SPPDSLVPAL

SEQ ID NO: 4382 - protein, 10 aa, Artificial Sequence
  Description of Artificial Sequence:  Synthetic Peptide
RPDDPHGTVF

SEQ ID NO: 4383 - protein, 9 aa, Artificial Sequence
  Description of Artificial Sequence:  Synthetic Peptide
KPRSSRLRL

SEQ ID NO: 4384 - protein, 9 aa, Artificial Sequence
  Description of Artificial Sequence:  Synthetic Peptide
KPRSSRLRL

SEQ ID NO: 4385 - protein, 10 aa, Artificial Sequence
  Description of Artificial Sequence:  Synthetic Peptide
RQGHLLDVWV

SEQ ID NO: 4386 - protein, 10 aa, Artificial Sequence
  Description of Artificial Sequence:  Synthetic Peptide
KPRSSRLRLV

SEQ ID NO: 4387 - protein, 10 aa, Artificial Sequence
  Description of Artificial Sequence:  Synthetic Peptide
KPRSSRLRLV

SEQ ID NO: 4388 - protein, 10 aa, Artificial Sequence
  Description of Artificial Sequence:  Synthetic Peptide
DLSSIRQGHL

SEQ ID NO: 4389 - protein, 10 aa, Artificial Sequence
  Description of Artificial Sequence:  Synthetic Peptide
KPRSSRLRLV

SEQ ID NO: 4390 - protein, 10 aa, Artificial Sequence
  Description of Artificial Sequence:  Synthetic Peptide
NEMPSPPDGF

SEQ ID NO: 4391 - protein, 9 aa, Artificial Sequence
  Description of Artificial Sequence:  Synthetic Peptide
DVGVNTVCL

SEQ ID NO: 4392 - protein, 9 aa, Artificial Sequence
  Description of Artificial Sequence:  Synthetic Peptide
RATTIGKKL

SEQ ID NO: 4393 - protein, 9 aa, Artificial Sequence
  Description of Artificial Sequence:  Synthetic Peptide
NLSLDLVLV

SEQ ID NO: 4394 - protein, 9 aa, Artificial Sequence
  Description of Artificial Sequence:  Synthetic Peptide
GLCCGGNHL

SEQ ID NO: 4395 - protein, 9 aa, Artificial Sequence
  Description of Artificial Sequence:  Synthetic Peptide
MVNGPTHAV

SEQ ID NO: 4396 - protein, 9 aa, Artificial Sequence
  Description of Artificial Sequence:  Synthetic Peptide
DLVLVPACK

SEQ ID NO: 4397 - protein, 10 aa, Artificial Sequence
  Description of Artificial Sequence:  Synthetic Peptide
AVDAGRQEGL

SEQ ID NO: 4398 - protein, 9 aa, Artificial Sequence
  Description of Artificial Sequence:  Synthetic Peptide
QLHEGHLDI

SEQ ID NO: 4399 - protein, 9 aa, Artificial Sequence
  Description of Artificial Sequence:  Synthetic Peptide
RAQLHEGHL

SEQ ID NO: 4400 - protein, 9 aa, Artificial Sequence
  Description of Artificial Sequence:  Synthetic Peptide
RAQLHEGHL

SEQ ID NO: 4401 - protein, 10 aa, Artificial Sequence
  Description of Artificial Sequence:  Synthetic Peptide
NVRACQRAQL

SEQ ID NO: 4402 - protein, 9 aa, Artificial Sequence
  Description of Artificial Sequence:  Synthetic Peptide
LEHHERTEY

SEQ ID NO: 4403 - protein, 10 aa, Artificial Sequence
  Description of Artificial Sequence:  Synthetic Peptide
SLEHHERTEY

SEQ ID NO: 4404 - protein, 10 aa, Artificial Sequence
  Description of Artificial Sequence:  Synthetic Peptide
EVRHSGYASL

SEQ ID NO: 4405 - protein, 10 aa, Artificial Sequence
  Description of Artificial Sequence:  Synthetic Peptide
SAHEVRHSGY

SEQ ID NO: 4406 - protein, 9 aa, Artificial Sequence
  Description of Artificial Sequence:  Synthetic Peptide
RGDPHLQVR

SEQ ID NO: 4407 - protein, 10 aa, Artificial Sequence
  Description of Artificial Sequence:  Synthetic Peptide
RGDPHLQVRL

SEQ ID NO: 4408 - protein, 10 aa, Artificial Sequence
  Description of Artificial Sequence:  Synthetic Peptide
QVRLGPGDKI

SEQ ID NO: 4409 - protein, 9 aa, Artificial Sequence
  Description of Artificial Sequence:  Synthetic Peptide
VYPGHVAHL

SEQ ID NO: 4410 - protein, 10 aa, Artificial Sequence
  Description of Artificial Sequence:  Synthetic Peptide
MVYPGHVAHL

SEQ ID NO: 4411 - protein, 10 aa, Artificial Sequence
  Description of Artificial Sequence:  Synthetic Peptide
VYPGHVAHLV

SEQ ID NO: 4412 - protein, 10 aa, Artificial Sequence
  Description of Artificial Sequence:  Synthetic Peptide
MVYPGHVAHL

SEQ ID NO: 4413 - protein, 9 aa, Artificial Sequence
  Description of Artificial Sequence:  Synthetic Peptide
TPGIGRVTW

SEQ ID NO: 4414 - protein, 9 aa, Artificial Sequence
  Description of Artificial Sequence:  Synthetic Peptide
QMWLCSSAA

SEQ ID NO: 4415 - protein, 9 aa, Artificial Sequence
  Description of Artificial Sequence:  Synthetic Peptide
GYRSHQMWL

SEQ ID NO: 4416 - protein, 10 aa, Artificial Sequence
  Description of Artificial Sequence:  Synthetic Peptide
VPMTASPGSF

SEQ ID NO: 4417 - protein, 10 aa, Artificial Sequence
  Description of Artificial Sequence:  Synthetic Peptide
SPGASRAREW

SEQ ID NO: 4418 - protein, 10 aa, Artificial Sequence
  Description of Artificial Sequence:  Synthetic Peptide
AGYRSHQMWL

SEQ ID NO: 4419 - protein, 9 aa, Artificial Sequence
  Description of Artificial Sequence:  Synthetic Peptide
ASRAREWEI

SEQ ID NO: 4420 - protein, 9 aa, Artificial Sequence
  Description of Artificial Sequence:  Synthetic Peptide
ASRAREWEI

SEQ ID NO: 4421 - protein, 10 aa, Artificial Sequence
  Description of Artificial Sequence:  Synthetic Peptide
ILTPLTSNVV

SEQ ID NO: 4422 - protein, 10 aa, Artificial Sequence
  Description of Artificial Sequence:  Synthetic Peptide
SILTPLTSNV

SEQ ID NO: 4423 - protein, 10 aa, Artificial Sequence
  Description of Artificial Sequence:  Synthetic Peptide
TVLGSILTPL

SEQ ID NO: 4424 - protein, 10 aa, Artificial Sequence
  Description of Artificial Sequence:  Synthetic Peptide
VLGSILTPLT

SEQ ID NO: 4425 - protein, 9 aa, Artificial Sequence
  Description of Artificial Sequence:  Synthetic Peptide
ILTPLTSNV

SEQ ID NO: 4426 - protein, 9 aa, Artificial Sequence
  Description of Artificial Sequence:  Synthetic Peptide
VLGSILTPL

SEQ ID NO: 4427 - protein, 9 aa, Artificial Sequence
  Description of Artificial Sequence:  Synthetic Peptide
TFCAPRTVL

SEQ ID NO: 4428 - protein, 10 aa, Artificial Sequence
  Description of Artificial Sequence:  Synthetic Peptide
APRTVLGSIL

SEQ ID NO: 4429 - protein, 9 aa, Artificial Sequence
  Description of Artificial Sequence:  Synthetic Peptide
APRTVLGSI

SEQ ID NO: 4430 - protein, 9 aa, Artificial Sequence
  Description of Artificial Sequence:  Synthetic Peptide
TPLTSNVVL

SEQ ID NO: 4431 - protein, 9 aa, Artificial Sequence
  Description of Artificial Sequence:  Synthetic Peptide
GPGSRRGAW

SEQ ID NO: 4432 - protein, 10 aa, Artificial Sequence
  Description of Artificial Sequence:  Synthetic Peptide
APRTVLGSIL

SEQ ID NO: 4433 - protein, 10 aa, Artificial Sequence
  Description of Artificial Sequence:  Synthetic Peptide
TVLGSILTPL

SEQ ID NO: 4434 - protein, 9 aa, Artificial Sequence
  Description of Artificial Sequence:  Synthetic Peptide
APRTVLGSI

SEQ ID NO: 4435 - protein, 9 aa, Artificial Sequence
  Description of Artificial Sequence:  Synthetic Peptide
TPLTSNVVL

SEQ ID NO: 4436 - protein, 10 aa, Artificial Sequence
  Description of Artificial Sequence:  Synthetic Peptide
APRTVLGSIL

SEQ ID NO: 4437 - protein, 8 aa, Artificial Sequence
  Description of Artificial Sequence:  Synthetic Peptide
FCAPRTVL

SEQ ID NO: 4438 - protein, 8 aa, Artificial Sequence
  Description of Artificial Sequence:  Synthetic Peptide
LPLQNMSF

SEQ ID NO: 4439 - protein, 10 aa, Artificial Sequence
  Description of Artificial Sequence:  Synthetic Peptide
YILSSFSWLL

SEQ ID NO: 4440 - protein, 10 aa, Artificial Sequence
  Description of Artificial Sequence:  Synthetic Peptide
FSWLLGTSKV

SEQ ID NO: 4441 - protein, 9 aa, Artificial Sequence
  Description of Artificial Sequence:  Synthetic Peptide
ILSSFSWLL

SEQ ID NO: 4442 - protein, 9 aa, Artificial Sequence
  Description of Artificial Sequence:  Synthetic Peptide
YILSSFSWL

SEQ ID NO: 4443 - protein, 9 aa, Artificial Sequence
  Description of Artificial Sequence:  Synthetic Peptide
RLMPMMHLC

SEQ ID NO: 4444 - protein, 10 aa, Artificial Sequence
  Description of Artificial Sequence:  Synthetic Peptide
RLMPMMHLCK

SEQ ID NO: 4445 - protein, 10 aa, Artificial Sequence
  Description of Artificial Sequence:  Synthetic Peptide
SYILSSFSWL

SEQ ID NO: 4446 - protein, 9 aa, Artificial Sequence
  Description of Artificial Sequence:  Synthetic Peptide
LMPMMHLCK

SEQ ID NO: 4447 - protein, 10 aa, Artificial Sequence
  Description of Artificial Sequence:  Synthetic Peptide
CSSHCPNRLM

SEQ ID NO: 4448 - protein, 8 aa, Artificial Sequence
  Description of Artificial Sequence:  Synthetic Peptide
CPNRLMPM

SEQ ID NO: 4449 - protein, 9 aa, Artificial Sequence
  Description of Artificial Sequence:  Synthetic Peptide
WPPIPSPAY

SEQ ID NO: 4450 - protein, 9 aa, Artificial Sequence
  Description of Artificial Sequence:  Synthetic Peptide
SPAYGPFAY

SEQ ID NO: 4451 - protein, 9 aa, Artificial Sequence
  Description of Artificial Sequence:  Synthetic Peptide
CPNRLMPMM

SEQ ID NO: 4452 - protein, 9 aa, Artificial Sequence
  Description of Artificial Sequence:  Synthetic Peptide
IPSPAYGPF

SEQ ID NO: 4453 - protein, 9 aa, Artificial Sequence
  Description of Artificial Sequence:  Synthetic Peptide
SSHCPNRLM

SEQ ID NO: 4454 - protein, 9 aa, Artificial Sequence
  Description of Artificial Sequence:  Synthetic Peptide
CPNRLMPMM

SEQ ID NO: 4455 - protein, 10 aa, Artificial Sequence
  Description of Artificial Sequence:  Synthetic Peptide
ALYGLPPYSA

SEQ ID NO: 4456 - protein, 9 aa, Artificial Sequence
  Description of Artificial Sequence:  Synthetic Peptide
GLPPYSARV

SEQ ID NO: 4457 - protein, 9 aa, Artificial Sequence
  Description of Artificial Sequence:  Synthetic Peptide
PYSARVWCL

SEQ ID NO: 4458 - protein, 10 aa, Artificial Sequence
  Description of Artificial Sequence:  Synthetic Peptide
GLPTACGTWR

SEQ ID NO: 4459 - protein, 8 aa, Artificial Sequence
  Description of Artificial Sequence:  Synthetic Peptide
SPLCRIGL

SEQ ID NO: 4460 - protein, 8 aa, Artificial Sequence
  Description of Artificial Sequence:  Synthetic Peptide
LPTACGTW

SEQ ID NO: 4461 - protein, 9 aa, Artificial Sequence
  Description of Artificial Sequence:  Synthetic Peptide
TACGTWRSL

SEQ ID NO: 4462 - protein, 8 aa, Artificial Sequence
  Description of Artificial Sequence:  Synthetic Peptide
SPLCRIGL

SEQ ID NO: 4463 - protein, 8 aa, Artificial Sequence
  Description of Artificial Sequence:  Synthetic Peptide
TPPRGGSF

SEQ ID NO: 4464 - protein, 9 aa, Artificial Sequence
  Description of Artificial Sequence:  Synthetic Peptide
CPPDSVGRF

SEQ ID NO: 4465 - protein, 9 aa, Artificial Sequence
  Description of Artificial Sequence:  Synthetic Peptide
TPSRHEVSW

SEQ ID NO: 4466 - protein, 10 aa, Artificial Sequence
  Description of Artificial Sequence:  Synthetic Peptide
SVGRFSLAQL

SEQ ID NO: 4467 - protein, 9 aa, Artificial Sequence
  Description of Artificial Sequence:  Synthetic Peptide
VGRFSLAQL

SEQ ID NO: 4468 - protein, 10 aa, Artificial Sequence
  Description of Artificial Sequence:  Synthetic Peptide
KAPKSLSRTL

SEQ ID NO: 4469 - protein, 9 aa, Artificial Sequence
  Description of Artificial Sequence:  Synthetic Peptide
APKSLSRTL

SEQ ID NO: 4470 - protein, 10 aa, Artificial Sequence
  Description of Artificial Sequence:  Synthetic Peptide
KAPKSLSRTL

SEQ ID NO: 4471 - protein, 9 aa, Artificial Sequence
  Description of Artificial Sequence:  Synthetic Peptide
APKSLSRTL

SEQ ID NO: 4472 - protein, 9 aa, Artificial Sequence
  Description of Artificial Sequence:  Synthetic Peptide
AVEKAPKSL

SEQ ID NO: 4473 - protein, 9 aa, Artificial Sequence
  Description of Artificial Sequence:  Synthetic Peptide
APKSLSRTL

SEQ ID NO: 4474 - protein, 10 aa, Artificial Sequence
  Description of Artificial Sequence:  Synthetic Peptide
IPTLGLESEL

SEQ ID NO: 4475 - protein, 10 aa, Artificial Sequence
  Description of Artificial Sequence:  Synthetic Peptide
IPTLGLESEL

SEQ ID NO: 4476 - protein, 9 aa, Artificial Sequence
  Description of Artificial Sequence:  Synthetic Peptide
MASIPTLGL

SEQ ID NO: 4477 - protein, 10 aa, Artificial Sequence
  Description of Artificial Sequence:  Synthetic Peptide
YATNATPWTL

SEQ ID NO: 4478 - protein, 10 aa, Artificial Sequence
  Description of Artificial Sequence:  Synthetic Peptide
ASEQFLTKQR

SEQ ID NO: 4479 - protein, 10 aa, Artificial Sequence
  Description of Artificial Sequence:  Synthetic Peptide
LPPSSASEQF

SEQ ID NO: 4480 - protein, 9 aa, Artificial Sequence
  Description of Artificial Sequence:  Synthetic Peptide
RAAPMTSSY

SEQ ID NO: 4481 - protein, 9 aa, Artificial Sequence
  Description of Artificial Sequence:  Synthetic Peptide
RAAPMTSSY

SEQ ID NO: 4482 - protein, 10 aa, Artificial Sequence
  Description of Artificial Sequence:  Synthetic Peptide
YATNATPWTL

SEQ ID NO: 4483 - protein, 9 aa, Artificial Sequence
  Description of Artificial Sequence:  Synthetic Peptide
APMTSSYAT

SEQ ID NO: 4484 - protein, 9 aa, Artificial Sequence
  Description of Artificial Sequence:  Synthetic Peptide
ATNATPWTL

SEQ ID NO: 4485 - protein, 10 aa, Artificial Sequence
  Description of Artificial Sequence:  Synthetic Peptide
MLWHTTEGWT

SEQ ID NO: 4486 - protein, 9 aa, Artificial Sequence
  Description of Artificial Sequence:  Synthetic Peptide
GAWAMLWHT

SEQ ID NO: 4487 - protein, 10 aa, Artificial Sequence
  Description of Artificial Sequence:  Synthetic Peptide
RPFGAWAMLW

SEQ ID NO: 4488 - protein, 8 aa, Artificial Sequence
  Description of Artificial Sequence:  Synthetic Peptide
RPFGAWAM

SEQ ID NO: 4489 - protein, 9 aa, Artificial Sequence
  Description of Artificial Sequence:  Synthetic Peptide
RPFGAWAML

SEQ ID NO: 4490 - protein, 10 aa, Artificial Sequence
  Description of Artificial Sequence:  Synthetic Peptide
RRPFGAWAML

SEQ ID NO: 4491 - protein, 9 aa, Artificial Sequence
  Description of Artificial Sequence:  Synthetic Peptide
RPFGAWAML

SEQ ID NO: 4492 - protein, 10 aa, Artificial Sequence
  Description of Artificial Sequence:  Synthetic Peptide
VSEPQGCLIA

SEQ ID NO: 4493 - protein, 9 aa, Artificial Sequence
  Description of Artificial Sequence:  Synthetic Peptide
VSEPQGCLI

SEQ ID NO: 4494 - protein, 10 aa, Artificial Sequence
  Description of Artificial Sequence:  Synthetic Peptide
RGMSLRQRRL

SEQ ID NO: 4495 - protein, 10 aa, Artificial Sequence
  Description of Artificial Sequence:  Synthetic Peptide
SEPQGCLIAW

SEQ ID NO: 4496 - protein, 10 aa, Artificial Sequence
  Description of Artificial Sequence:  Synthetic Peptide
RGMSLRQRRL

SEQ ID NO: 4497 - protein, 9 aa, Artificial Sequence
  Description of Artificial Sequence:  Synthetic Peptide
LVSEPQGCL

SEQ ID NO: 4498 - protein, 9 aa, Artificial Sequence
  Description of Artificial Sequence:  Synthetic Peptide
SVSATTQGL

SEQ ID NO: 4499 - protein, 10 aa, Artificial Sequence
  Description of Artificial Sequence:  Synthetic Peptide
FPKQSNRGRI

SEQ ID NO: 4500 - protein, 10 aa, Artificial Sequence
  Description of Artificial Sequence:  Synthetic Peptide
FPKQSNRGRI

SEQ ID NO: 4501 - protein, 10 aa, Artificial Sequence
  Description of Artificial Sequence:  Synthetic Peptide
LLMKWRNVPL

SEQ ID NO: 4502 - protein, 9 aa, Artificial Sequence
  Description of Artificial Sequence:  Synthetic Peptide
RLLMKWRNV

SEQ ID NO: 4503 - protein, 10 aa, Artificial Sequence
  Description of Artificial Sequence:  Synthetic Peptide
RNVPLKRLSL

SEQ ID NO: 4504 - protein, 10 aa, Artificial Sequence
  Description of Artificial Sequence:  Synthetic Peptide
LMKWRNVPLK

SEQ ID NO: 4505 - protein, 10 aa, Artificial Sequence
  Description of Artificial Sequence:  Synthetic Peptide
SLKRGSGWPR

SEQ ID NO: 4506 - protein, 8 aa, Artificial Sequence
  Description of Artificial Sequence:  Synthetic Peptide
VPLKRLSL

SEQ ID NO: 4507 - protein, 10 aa, Artificial Sequence
  Description of Artificial Sequence:  Synthetic Peptide
LLMKWRNVPL

SEQ ID NO: 4508 - protein, 9 aa, Artificial Sequence
  Description of Artificial Sequence:  Synthetic Peptide
NVPLKRLSL

SEQ ID NO: 4509 - protein, 8 aa, Artificial Sequence
  Description of Artificial Sequence:  Synthetic Peptide
VPLKRLSL

SEQ ID NO: 4510 - protein, 9 aa, Artificial Sequence
  Description of Artificial Sequence:  Synthetic Peptide
LMKWRNVPL

SEQ ID NO: 4511 - protein, 10 aa, Artificial Sequence
  Description of Artificial Sequence:  Synthetic Peptide
TLARSPPWRT

SEQ ID NO: 4512 - protein, 9 aa, Artificial Sequence
  Description of Artificial Sequence:  Synthetic Peptide
SICCLGFCL

SEQ ID NO: 4513 - protein, 10 aa, Artificial Sequence
  Description of Artificial Sequence:  Synthetic Peptide
SSHSRSTLAR

SEQ ID NO: 4514 - protein, 10 aa, Artificial Sequence
  Description of Artificial Sequence:  Synthetic Peptide
GPSSHSRSTL

SEQ ID NO: 4515 - protein, 10 aa, Artificial Sequence
  Description of Artificial Sequence:  Synthetic Peptide
GPSSHSRSTL

SEQ ID NO: 4516 - protein, 9 aa, Artificial Sequence
  Description of Artificial Sequence:  Synthetic Peptide
RLPLGSIHL

SEQ ID NO: 4517 - protein, 9 aa, Artificial Sequence
  Description of Artificial Sequence:  Synthetic Peptide
RLPLGSIHL

SEQ ID NO: 4518 - protein, 8 aa, Artificial Sequence
  Description of Artificial Sequence:  Synthetic Peptide
LPLGSIHL

SEQ ID NO: 4519 - protein, 9 aa, Artificial Sequence
  Description of Artificial Sequence:  Synthetic Peptide
RSRLPLGSI

SEQ ID NO: 4520 - protein, 10 aa, Artificial Sequence
  Description of Artificial Sequence:  Synthetic Peptide
MMWTWWMPTC

SEQ ID NO: 4521 - protein, 9 aa, Artificial Sequence
  Description of Artificial Sequence:  Synthetic Peptide
MMWTWWMPT

SEQ ID NO: 4522 - protein, 9 aa, Artificial Sequence
  Description of Artificial Sequence:  Synthetic Peptide
WMPTCSWGA

SEQ ID NO: 4523 - protein, 9 aa, Artificial Sequence
  Description of Artificial Sequence:  Synthetic Peptide
MPTCSWGAM

SEQ ID NO: 4524 - protein, 9 aa, Artificial Sequence
  Description of Artificial Sequence:  Synthetic Peptide
MPTCSWGAM

SEQ ID NO: 4525 - protein, 10 aa, Artificial Sequence
  Description of Artificial Sequence:  Synthetic Peptide
LMSWPFRRQV

SEQ ID NO: 4526 - protein, 10 aa, Artificial Sequence
  Description of Artificial Sequence:  Synthetic Peptide
SLGIQTWSPT

SEQ ID NO: 4527 - protein, 10 aa, Artificial Sequence
  Description of Artificial Sequence:  Synthetic Peptide
WPSKPSASPL

SEQ ID NO: 4528 - protein, 8 aa, Artificial Sequence
  Description of Artificial Sequence:  Synthetic Peptide
RPLMSWPF

SEQ ID NO: 4529 - protein, 8 aa, Artificial Sequence
  Description of Artificial Sequence:  Synthetic Peptide
TPAVGRPL

SEQ ID NO: 4530 - protein, 8 aa, Artificial Sequence
  Description of Artificial Sequence:  Synthetic Peptide
WPFRRQVL

SEQ ID NO: 4531 - protein, 8 aa, Artificial Sequence
  Description of Artificial Sequence:  Synthetic Peptide
CPPSRGSL

SEQ ID NO: 4532 - protein, 9 aa, Artificial Sequence
  Description of Artificial Sequence:  Synthetic Peptide
TPAVGRPLM

SEQ ID NO: 4533 - protein, 10 aa, Artificial Sequence
  Description of Artificial Sequence:  Synthetic Peptide
WPSKPSASPL

SEQ ID NO: 4534 - protein, 10 aa, Artificial Sequence
  Description of Artificial Sequence:  Synthetic Peptide
PPCPPSRGSL

SEQ ID NO: 4535 - protein, 9 aa, Artificial Sequence
  Description of Artificial Sequence:  Synthetic Peptide
TPAVGRPLM

SEQ ID NO: 4536 - protein, 8 aa, Artificial Sequence
  Description of Artificial Sequence:  Synthetic Peptide
WPFRRQVL

SEQ ID NO: 4537 - protein, 8 aa, Artificial Sequence
  Description of Artificial Sequence:  Synthetic Peptide
CPPSRGSL

SEQ ID NO: 4538 - protein, 10 aa, Artificial Sequence
  Description of Artificial Sequence:  Synthetic Peptide
KQLALSFTLT

SEQ ID NO: 4539 - protein, 10 aa, Artificial Sequence
  Description of Artificial Sequence:  Synthetic Peptide
LALSFTLTSV

SEQ ID NO: 4540 - protein, 9 aa, Artificial Sequence
  Description of Artificial Sequence:  Synthetic Peptide
FMMSHKSFL

SEQ ID NO: 4541 - protein, 9 aa, Artificial Sequence
  Description of Artificial Sequence:  Synthetic Peptide
KQLALSFTL

SEQ ID NO: 4542 - protein, 9 aa, Artificial Sequence
  Description of Artificial Sequence:  Synthetic Peptide
ALSFTLTSV

SEQ ID NO: 4543 - protein, 9 aa, Artificial Sequence
  Description of Artificial Sequence:  Synthetic Peptide
QLALSFTLT

SEQ ID NO: 4544 - protein, 9 aa, Artificial Sequence
  Description of Artificial Sequence:  Synthetic Peptide
WTPPRGVRK

SEQ ID NO: 4545 - protein, 10 aa, Artificial Sequence
  Description of Artificial Sequence:  Synthetic Peptide
RFAACPGGPL

SEQ ID NO: 4546 - protein, 9 aa, Artificial Sequence
  Description of Artificial Sequence:  Synthetic Peptide
KQLALSFTL

SEQ ID NO: 4547 - protein, 9 aa, Artificial Sequence
  Description of Artificial Sequence:  Synthetic Peptide
RGVRKQLAL

SEQ ID NO: 4548 - protein, 10 aa, Artificial Sequence
  Description of Artificial Sequence:  Synthetic Peptide
FMMSHKSFLR

SEQ ID NO: 4549 - protein, 10 aa, Artificial Sequence
  Description of Artificial Sequence:  Synthetic Peptide
HQFLRPSWPK

SEQ ID NO: 4550 - protein, 9 aa, Artificial Sequence
  Description of Artificial Sequence:  Synthetic Peptide
MMSHKSFLR

SEQ ID NO: 4551 - protein, 10 aa, Artificial Sequence
  Description of Artificial Sequence:  Synthetic Peptide
TPPRGVRKQL

SEQ ID NO: 4552 - protein, 10 aa, Artificial Sequence
  Description of Artificial Sequence:  Synthetic Peptide
WPFMMSHKSF

SEQ ID NO: 4553 - protein, 10 aa, Artificial Sequence
  Description of Artificial Sequence:  Synthetic Peptide
GSARRWPFMM

SEQ ID NO: 4554 - protein, 8 aa, Artificial Sequence
  Description of Artificial Sequence:  Synthetic Peptide
SARRWPFM

SEQ ID NO: 4555 - protein, 8 aa, Artificial Sequence
  Description of Artificial Sequence:  Synthetic Peptide
SPCGRTSW

SEQ ID NO: 4556 - protein, 9 aa, Artificial Sequence
  Description of Artificial Sequence:  Synthetic Peptide
WPKMRCSAW

SEQ ID NO: 4557 - protein, 9 aa, Artificial Sequence
  Description of Artificial Sequence:  Synthetic Peptide
SARRWPFMM

SEQ ID NO: 4558 - protein, 9 aa, Artificial Sequence
  Description of Artificial Sequence:  Synthetic Peptide
GSARRWPFM

SEQ ID NO: 4559 - protein, 10 aa, Artificial Sequence
  Description of Artificial Sequence:  Synthetic Peptide
TPPRGVRKQL

SEQ ID NO: 4560 - protein, 10 aa, Artificial Sequence
  Description of Artificial Sequence:  Synthetic Peptide
ALSFTLTSVL

SEQ ID NO: 4561 - protein, 9 aa, Artificial Sequence
  Description of Artificial Sequence:  Synthetic Peptide
PPRGVRKQL

SEQ ID NO: 4562 - protein, 9 aa, Artificial Sequence
  Description of Artificial Sequence:  Synthetic Peptide
SARRWPFMM

SEQ ID NO: 4563 - protein, 9 aa, Artificial Sequence
  Description of Artificial Sequence:  Synthetic Peptide
FAACPGGPL

SEQ ID NO: 4564 - protein, 9 aa, Artificial Sequence
  Description of Artificial Sequence:  Synthetic Peptide
FMMSHKSFL

SEQ ID NO: 4565 - protein, 9 aa, Artificial Sequence
  Description of Artificial Sequence:  Synthetic Peptide
FLRPSWPKM

SEQ ID NO: 4566 - protein, 8 aa, Artificial Sequence
  Description of Artificial Sequence:  Synthetic Peptide
WPKMRCSA

SEQ ID NO: 4567 - protein, 10 aa, Artificial Sequence
  Description of Artificial Sequence:  Synthetic Peptide
RLAPCLRRPV

SEQ ID NO: 4568 - protein, 9 aa, Artificial Sequence
  Description of Artificial Sequence:  Synthetic Peptide
TLPSLRETL

SEQ ID NO: 4569 - protein, 10 aa, Artificial Sequence
  Description of Artificial Sequence:  Synthetic Peptide
TLELRRPYTR

SEQ ID NO: 4570 - protein, 9 aa, Artificial Sequence
  Description of Artificial Sequence:  Synthetic Peptide
PYTRLAPCL

SEQ ID NO: 4571 - protein, 10 aa, Artificial Sequence
  Description of Artificial Sequence:  Synthetic Peptide
TLELRRPYTR

SEQ ID NO: 4572 - protein, 10 aa, Artificial Sequence
  Description of Artificial Sequence:  Synthetic Peptide
SLRETLELRR

SEQ ID NO: 4573 - protein, 10 aa, Artificial Sequence
  Description of Artificial Sequence:  Synthetic Peptide
TLELRRPYTR

SEQ ID NO: 4574 - protein, 9 aa, Artificial Sequence
  Description of Artificial Sequence:  Synthetic Peptide
CLRRPVLPY

SEQ ID NO: 4575 - protein, 10 aa, Artificial Sequence
  Description of Artificial Sequence:  Synthetic Peptide
RPYTRLAPCL

SEQ ID NO: 4576 - protein, 10 aa, Artificial Sequence
  Description of Artificial Sequence:  Synthetic Peptide
LPSLRETLEL

SEQ ID NO: 4577 - protein, 8 aa, Artificial Sequence
  Description of Artificial Sequence:  Synthetic Peptide
LPSLRETL

SEQ ID NO: 4578 - protein, 9 aa, Artificial Sequence
  Description of Artificial Sequence:  Synthetic Peptide
APCLRRPVL

SEQ ID NO: 4579 - protein, 10 aa, Artificial Sequence
  Description of Artificial Sequence:  Synthetic Peptide
LPSLRETLEL

SEQ ID NO: 4580 - protein, 10 aa, Artificial Sequence
  Description of Artificial Sequence:  Synthetic Peptide
RPYTRLAPCL

SEQ ID NO: 4581 - protein, 10 aa, Artificial Sequence
  Description of Artificial Sequence:  Synthetic Peptide
TPDALTLPSL

SEQ ID NO: 4582 - protein, 10 aa, Artificial Sequence
  Description of Artificial Sequence:  Synthetic Peptide
LAPCLRRPVL

SEQ ID NO: 4583 - protein, 9 aa, Artificial Sequence
  Description of Artificial Sequence:  Synthetic Peptide
APCLRRPVL

SEQ ID NO: 4584 - protein, 9 aa, Artificial Sequence
  Description of Artificial Sequence:  Synthetic Peptide
ELRRPYTRL

SEQ ID NO: 4585 - protein, 10 aa, Artificial Sequence
  Description of Artificial Sequence:  Synthetic Peptide
LAPCLRRPVL

SEQ ID NO: 4586 - protein, 8 aa, Artificial Sequence
  Description of Artificial Sequence:  Synthetic Peptide
LPSLRETL

SEQ ID NO: 4587 - protein, 8 aa, Artificial Sequence
  Description of Artificial Sequence:  Synthetic Peptide
SLRETLEL

SEQ ID NO: 4588 - protein, 9 aa, Artificial Sequence
  Description of Artificial Sequence:  Synthetic Peptide
ELRRPYTRL

SEQ ID NO: 4589 - protein, 9 aa, Artificial Sequence
  Description of Artificial Sequence:  Synthetic Peptide
APCLRRPVL

SEQ ID NO: 4590 - protein, 10 aa, Artificial Sequence
  Description of Artificial Sequence:  Synthetic Peptide
WLSSQKARGL

SEQ ID NO: 4591 - protein, 10 aa, Artificial Sequence
  Description of Artificial Sequence:  Synthetic Peptide
CLWHSAYRAA

SEQ ID NO: 4592 - protein, 9 aa, Artificial Sequence
  Description of Artificial Sequence:  Synthetic Peptide
CLWHSAYRA

SEQ ID NO: 4593 - protein, 10 aa, Artificial Sequence
  Description of Artificial Sequence:  Synthetic Peptide
APVPPRFSSL

SEQ ID NO: 4594 - protein, 9 aa, Artificial Sequence
  Description of Artificial Sequence:  Synthetic Peptide
VPPRFSSLL

SEQ ID NO: 4595 - protein, 10 aa, Artificial Sequence
  Description of Artificial Sequence:  Synthetic Peptide
APVPPRFSSL

SEQ ID NO: 4596 - protein, 10 aa, Artificial Sequence
  Description of Artificial Sequence:  Synthetic Peptide
SYGVGHDDEL

SEQ ID NO: 4597 - protein, 9 aa, Artificial Sequence
  Description of Artificial Sequence:  Synthetic Peptide
HDDELVTHY

SEQ ID NO: 4598 - protein, 9 aa, Artificial Sequence
  Description of Artificial Sequence:  Synthetic Peptide
VLFHPQPSR

SEQ ID NO: 4599 - protein, 10 aa, Artificial Sequence
  Description of Artificial Sequence:  Synthetic Peptide
SPREVRVRPS

SEQ ID NO: 4600 - protein, 9 aa, Artificial Sequence
  Description of Artificial Sequence:  Synthetic Peptide
EVRVRPSVL

SEQ ID NO: 4601 - protein, 10 aa, Artificial Sequence
  Description of Artificial Sequence:  Synthetic Peptide
SPREVRVRPS

SEQ ID NO: 4602 - protein, 8 aa, Artificial Sequence
  Description of Artificial Sequence:  Synthetic Peptide
EVRVRPSV

SEQ ID NO: 4603 - protein, 9 aa, Artificial Sequence
  Description of Artificial Sequence:  Synthetic Peptide
EVRVRPSVL

SEQ ID NO: 4604 - protein, 9 aa, Artificial Sequence
  Description of Artificial Sequence:  Synthetic Peptide
MVRLHVDEL

SEQ ID NO: 4605 - protein, 9 aa, Artificial Sequence
  Description of Artificial Sequence:  Synthetic Peptide
RLPLQALAL

SEQ ID NO: 4606 - protein, 10 aa, Artificial Sequence
  Description of Artificial Sequence:  Synthetic Peptide
WFWALAHAEF

SEQ ID NO: 4607 - protein, 9 aa, Artificial Sequence
  Description of Artificial Sequence:  Synthetic Peptide
RLPLQALAL

SEQ ID NO: 4608 - protein, 10 aa, Artificial Sequence
  Description of Artificial Sequence:  Synthetic Peptide
ALAHAEFPGR

SEQ ID NO: 4609 - protein, 10 aa, Artificial Sequence
  Description of Artificial Sequence:  Synthetic Peptide
FPGRLPLQAL

SEQ ID NO: 4610 - protein, 10 aa, Artificial Sequence
  Description of Artificial Sequence:  Synthetic Peptide
LPLQALALPL

SEQ ID NO: 4611 - protein, 8 aa, Artificial Sequence
  Description of Artificial Sequence:  Synthetic Peptide
LPLQALAL

SEQ ID NO: 4612 - protein, 10 aa, Artificial Sequence
  Description of Artificial Sequence:  Synthetic Peptide
FPGRLPLQAL

SEQ ID NO: 4613 - protein, 10 aa, Artificial Sequence
  Description of Artificial Sequence:  Synthetic Peptide
LPLQALALPL

SEQ ID NO: 4614 - protein, 10 aa, Artificial Sequence
  Description of Artificial Sequence:  Synthetic Peptide
LAHAEFPGRL

SEQ ID NO: 4615 - protein, 10 aa, Artificial Sequence
  Description of Artificial Sequence:  Synthetic Peptide
LLFLRLARFV

SEQ ID NO: 4616 - protein, 10 aa, Artificial Sequence
  Description of Artificial Sequence:  Synthetic Peptide
RLARFVDWST

SEQ ID NO: 4617 - protein, 9 aa, Artificial Sequence
  Description of Artificial Sequence:  Synthetic Peptide
HLALLFLRL

SEQ ID NO: 4618 - protein, 9 aa, Artificial Sequence
  Description of Artificial Sequence:  Synthetic Peptide
WSTPPPPKY

SEQ ID NO: 4619 - protein, 9 aa, Artificial Sequence
  Description of Artificial Sequence:  Synthetic Peptide
VTCPYKICR

SEQ ID NO: 4620 - protein, 10 aa, Artificial Sequence
  Description of Artificial Sequence:  Synthetic Peptide
KYRGRTIHVW

SEQ ID NO: 4621 - protein, 9 aa, Artificial Sequence
  Description of Artificial Sequence:  Synthetic Peptide
RSMGVGSAL

SEQ ID NO: 4622 - protein, 9 aa, Artificial Sequence
  Description of Artificial Sequence:  Synthetic Peptide
KYRGRTIHV

SEQ ID NO: 4623 - protein, 10 aa, Artificial Sequence
  Description of Artificial Sequence:  Synthetic Peptide
HVWPVTCPYK

SEQ ID NO: 4624 - protein, 9 aa, Artificial Sequence
  Description of Artificial Sequence:  Synthetic Peptide
GLRLRVDAY

SEQ ID NO: 4625 - protein, 9 aa, Artificial Sequence
  Description of Artificial Sequence:  Synthetic Peptide
LLFLRLARF

SEQ ID NO: 4626 - protein, 9 aa, Artificial Sequence
  Description of Artificial Sequence:  Synthetic Peptide
ALLFLRLAR

SEQ ID NO: 4627 - protein, 10 aa, Artificial Sequence
  Description of Artificial Sequence:  Synthetic Peptide
IPSPSGRQGL

SEQ ID NO: 4628 - protein, 10 aa, Artificial Sequence
  Description of Artificial Sequence:  Synthetic Peptide
SPSGRQGLRL

SEQ ID NO: 4629 - protein, 8 aa, Artificial Sequence
  Description of Artificial Sequence:  Synthetic Peptide
SPSGRQGL

SEQ ID NO: 4630 - protein, 9 aa, Artificial Sequence
  Description of Artificial Sequence:  Synthetic Peptide
CPYKICRSM

SEQ ID NO: 4631 - protein, 9 aa, Artificial Sequence
  Description of Artificial Sequence:  Synthetic Peptide
WSTPPPPKY

SEQ ID NO: 4632 - protein, 9 aa, Artificial Sequence
  Description of Artificial Sequence:  Synthetic Peptide
RSMGVGSAL

SEQ ID NO: 4633 - protein, 10 aa, Artificial Sequence
  Description of Artificial Sequence:  Synthetic Peptide
QGLRLRVDAY

SEQ ID NO: 4634 - protein, 9 aa, Artificial Sequence
  Description of Artificial Sequence:  Synthetic Peptide
REAGRLARC

SEQ ID NO: 4635 - protein, 10 aa, Artificial Sequence
  Description of Artificial Sequence:  Synthetic Peptide
IPSPSGRQGL

SEQ ID NO: 4636 - protein, 10 aa, Artificial Sequence
  Description of Artificial Sequence:  Synthetic Peptide
SPSGRQGLRL

SEQ ID NO: 4637 - protein, 10 aa, Artificial Sequence
  Description of Artificial Sequence:  Synthetic Peptide
GLRLRVDAYL

SEQ ID NO: 4638 - protein, 9 aa, Artificial Sequence
  Description of Artificial Sequence:  Synthetic Peptide
CPYKICRSM

SEQ ID NO: 4639 - protein, 9 aa, Artificial Sequence
  Description of Artificial Sequence:  Synthetic Peptide
RSMGVGSAL

SEQ ID NO: 4640 - protein, 8 aa, Artificial Sequence
  Description of Artificial Sequence:  Synthetic Peptide
SPSGRQGL

SEQ ID NO: 4641 - protein, 9 aa, Artificial Sequence
  Description of Artificial Sequence:  Synthetic Peptide
ALLPTAPRT

SEQ ID NO: 4642 - protein, 9 aa, Artificial Sequence
  Description of Artificial Sequence:  Synthetic Peptide
APRTAPTGL

SEQ ID NO: 4643 - protein, 10 aa, Artificial Sequence
  Description of Artificial Sequence:  Synthetic Peptide
APRTAPTGLC

SEQ ID NO: 4644 - protein, 10 aa, Artificial Sequence
  Description of Artificial Sequence:  Synthetic Peptide
TAPRTAPTGL

SEQ ID NO: 4645 - protein, 9 aa, Artificial Sequence
  Description of Artificial Sequence:  Synthetic Peptide
APRTAPTGL

SEQ ID NO: 4646 - protein, 9 aa, Artificial Sequence
  Description of Artificial Sequence:  Synthetic Peptide
APRTAPTGL

SEQ ID NO: 4647 - protein, 10 aa, Artificial Sequence
  Description of Artificial Sequence:  Synthetic Peptide
RPTRSGDSPW

SEQ ID NO: 4648 - protein, 10 aa, Artificial Sequence
  Description of Artificial Sequence:  Synthetic Peptide
RYHHPRHRNS

SEQ ID NO: 4649 - protein, 9 aa, Artificial Sequence
  Description of Artificial Sequence:  Synthetic Peptide
RYHHPRHRN

SEQ ID NO: 4650 - protein, 10 aa, Artificial Sequence
  Description of Artificial Sequence:  Synthetic Peptide
AILGQTHVEL

SEQ ID NO: 4651 - protein, 9 aa, Artificial Sequence
  Description of Artificial Sequence:  Synthetic Peptide
ILGQTHVEL

SEQ ID NO: 4652 - protein, 10 aa, Artificial Sequence
  Description of Artificial Sequence:  Synthetic Peptide
AILGQTHVEL

SEQ ID NO: 4653 - protein, 10 aa, Artificial Sequence
  Description of Artificial Sequence:  Synthetic Peptide
ACDPTAWLPY

SEQ ID NO: 4654 - protein, 8 aa, Artificial Sequence
  Description of Artificial Sequence:  Synthetic Peptide
KPRRPYPL

SEQ ID NO: 4655 - protein, 8 aa, Artificial Sequence
  Description of Artificial Sequence:  Synthetic Peptide
DPTAWLPY

SEQ ID NO: 4656 - protein, 9 aa, Artificial Sequence
  Description of Artificial Sequence:  Synthetic Peptide
DPTAWLPYY

SEQ ID NO: 4657 - protein, 10 aa, Artificial Sequence
  Description of Artificial Sequence:  Synthetic Peptide
CDPTAWLPYY

SEQ ID NO: 4658 - protein, 10 aa, Artificial Sequence
  Description of Artificial Sequence:  Synthetic Peptide
ACDPTAWLPY

SEQ ID NO: 4659 - protein, 9 aa, Artificial Sequence
  Description of Artificial Sequence:  Synthetic Peptide
DEQAHSLCF

SEQ ID NO: 4660 - protein, 9 aa, Artificial Sequence
  Description of Artificial Sequence:  Synthetic Peptide
CDPTAWLPY

SEQ ID NO: 4661 - protein, 9 aa, Artificial Sequence
  Description of Artificial Sequence:  Synthetic Peptide
DPTAWLPYY

SEQ ID NO: 4662 - protein, 10 aa, Artificial Sequence
  Description of Artificial Sequence:  Synthetic Peptide
VAACDPTAWL

SEQ ID NO: 4663 - protein, 9 aa, Artificial Sequence
  Description of Artificial Sequence:  Synthetic Peptide
AACDPTAWL

SEQ ID NO: 4664 - protein, 9 aa, Artificial Sequence
  Description of Artificial Sequence:  Synthetic Peptide
MLCEGPSGL

SEQ ID NO: 4665 - protein, 10 aa, Artificial Sequence
  Description of Artificial Sequence:  Synthetic Peptide
YMGPHGPDDT

SEQ ID NO: 4666 - protein, 10 aa, Artificial Sequence
  Description of Artificial Sequence:  Synthetic Peptide
GPHGPDDTFF

SEQ ID NO: 4667 - protein, 8 aa, Artificial Sequence
  Description of Artificial Sequence:  Synthetic Peptide
HPVCSNYM

SEQ ID NO: 4668 - protein, 8 aa, Artificial Sequence
  Description of Artificial Sequence:  Synthetic Peptide
GPDDTFFL

SEQ ID NO: 4669 - protein, 9 aa, Artificial Sequence
  Description of Artificial Sequence:  Synthetic Peptide
GPHGPDDTF

SEQ ID NO: 4670 - protein, 10 aa, Artificial Sequence
  Description of Artificial Sequence:  Synthetic Peptide
SVVQPPGPPL

SEQ ID NO: 4671 - protein, 9 aa, Artificial Sequence
  Description of Artificial Sequence:  Synthetic Peptide
VVQPPGPPL

SEQ ID NO: 4672 - protein, 9 aa, Artificial Sequence
  Description of Artificial Sequence:  Synthetic Peptide
YSWSILDDV

SEQ ID NO: 4673 - protein, 10 aa, Artificial Sequence
  Description of Artificial Sequence:  Synthetic Peptide
RLLQGEELCA

SEQ ID NO: 4674 - protein, 10 aa, Artificial Sequence
  Description of Artificial Sequence:  Synthetic Peptide
LQGEELCADL

SEQ ID NO: 4675 - protein, 10 aa, Artificial Sequence
  Description of Artificial Sequence:  Synthetic Peptide
LARLLQGEEL

SEQ ID NO: 4676 - protein, 10 aa, Artificial Sequence
  Description of Artificial Sequence:  Synthetic Peptide
LARLLQGEEL

SEQ ID NO: 4677 - protein, 9 aa, Artificial Sequence
  Description of Artificial Sequence:  Synthetic Peptide
KGYEPVHPL

SEQ ID NO: 4678 - protein, 9 aa, Artificial Sequence
  Description of Artificial Sequence:  Synthetic Peptide
VLHGGLLAR

SEQ ID NO: 4679 - protein, 9 aa, Artificial Sequence
  Description of Artificial Sequence:  Synthetic Peptide
NPRQQIDDV

SEQ ID NO: 4680 - protein, 9 aa, Artificial Sequence
  Description of Artificial Sequence:  Synthetic Peptide
NPRQQIDDV

SEQ ID NO: 4681 - protein, 9 aa, Artificial Sequence
  Description of Artificial Sequence:  Synthetic Peptide
DEGPRNARA

SEQ ID NO: 4682 - protein, 10 aa, Artificial Sequence
  Description of Artificial Sequence:  Synthetic Peptide
GYEPVHPLDR

SEQ ID NO: 4683 - protein, 10 aa, Artificial Sequence
  Description of Artificial Sequence:  Synthetic Peptide
GLLARHDLEC

SEQ ID NO: 4684 - protein, 10 aa, Artificial Sequence
  Description of Artificial Sequence:  Synthetic Peptide
IPRQDIHQHL

SEQ ID NO: 4685 - protein, 10 aa, Artificial Sequence
  Description of Artificial Sequence:  Synthetic Peptide
NPRQQIDDVL

SEQ ID NO: 4686 - protein, 10 aa, Artificial Sequence
  Description of Artificial Sequence:  Synthetic Peptide
NARAIPRQDI

SEQ ID NO: 4687 - protein, 10 aa, Artificial Sequence
  Description of Artificial Sequence:  Synthetic Peptide
IPRQDIHQHL

SEQ ID NO: 4688 - protein, 10 aa, Artificial Sequence
  Description of Artificial Sequence:  Synthetic Peptide
NPRQQIDDVL

SEQ ID NO: 4689 - protein, 10 aa, Artificial Sequence
  Description of Artificial Sequence:  Synthetic Peptide
IPRQDIHQHL

SEQ ID NO: 4690 - protein, 10 aa, Artificial Sequence
  Description of Artificial Sequence:  Synthetic Peptide
NPRQQIDDVL

SEQ ID NO: 4691 - protein, 10 aa, Artificial Sequence
  Description of Artificial Sequence:  Synthetic Peptide
EPVHPLDRAF

SEQ ID NO: 4692 - protein, 10 aa, Artificial Sequence
  Description of Artificial Sequence:  Synthetic Peptide
DEGPRNARAI

SEQ ID NO: 4693 - protein, 9 aa, Artificial Sequence
  Description of Artificial Sequence:  Synthetic Peptide
LVGNRAQTV

SEQ ID NO: 4694 - protein, 9 aa, Artificial Sequence
  Description of Artificial Sequence:  Synthetic Peptide
RVEIRSKPY

SEQ ID NO: 4695 - protein, 9 aa, Artificial Sequence
  Description of Artificial Sequence:  Synthetic Peptide
LTEHHAIKH

SEQ ID NO: 4696 - protein, 9 aa, Artificial Sequence
  Description of Artificial Sequence:  Synthetic Peptide
KLIPRSPCV

SEQ ID NO: 4697 - protein, 9 aa, Artificial Sequence
  Description of Artificial Sequence:  Synthetic Peptide
ALTEHHAIK

SEQ ID NO: 4698 - protein, 9 aa, Artificial Sequence
  Description of Artificial Sequence:  Synthetic Peptide
IPRSPCVVA

SEQ ID NO: 4699 - protein, 10 aa, Artificial Sequence
  Description of Artificial Sequence:  Synthetic Peptide
KLIPRSPCVV

SEQ ID NO: 4700 - protein, 10 aa, Artificial Sequence
  Description of Artificial Sequence:  Synthetic Peptide
VLAHGQARRV

SEQ ID NO: 4701 - protein, 10 aa, Artificial Sequence
  Description of Artificial Sequence:  Synthetic Peptide
PYGSLRWRKL

SEQ ID NO: 4702 - protein, 10 aa, Artificial Sequence
  Description of Artificial Sequence:  Synthetic Peptide
KPYGSLRWRK

SEQ ID NO: 4703 - protein, 10 aa, Artificial Sequence
  Description of Artificial Sequence:  Synthetic Peptide
SLRWRKLIPR

SEQ ID NO: 4704 - protein, 10 aa, Artificial Sequence
  Description of Artificial Sequence:  Synthetic Peptide
IPRSPCVVAL

SEQ ID NO: 4705 - protein, 10 aa, Artificial Sequence
  Description of Artificial Sequence:  Synthetic Peptide
EIRSKPYGSL

SEQ ID NO: 4706 - protein, 10 aa, Artificial Sequence
  Description of Artificial Sequence:  Synthetic Peptide
IPRSPCVVAL

SEQ ID NO: 4707 - protein, 10 aa, Artificial Sequence
  Description of Artificial Sequence:  Synthetic Peptide
IPRSPCVVAL

SEQ ID NO: 4708 - protein, 10 aa, Artificial Sequence
  Description of Artificial Sequence:  Synthetic Peptide
RSKPYGSLRW

SEQ ID NO: 4709 - protein, 10 aa, Artificial Sequence
  Description of Artificial Sequence:  Synthetic Peptide
VEIRSKPYGS

SEQ ID NO: 4710 - protein, 9 aa, Artificial Sequence
  Description of Artificial Sequence:  Synthetic Peptide
TLLPEGHLL

SEQ ID NO: 4711 - protein, 9 aa, Artificial Sequence
  Description of Artificial Sequence:  Synthetic Peptide
LLPEGHLLY

SEQ ID NO: 4712 - protein, 9 aa, Artificial Sequence
  Description of Artificial Sequence:  Synthetic Peptide
SPIEGDLTL

SEQ ID NO: 4713 - protein, 9 aa, Artificial Sequence
  Description of Artificial Sequence:  Synthetic Peptide
SPIEGDLTL

SEQ ID NO: 4714 - protein, 9 aa, Artificial Sequence
  Description of Artificial Sequence:  Synthetic Peptide
AEDQVSPSL

SEQ ID NO: 4715 - protein, 10 aa, Artificial Sequence
  Description of Artificial Sequence:  Synthetic Peptide
TLLPEGHLLY

SEQ ID NO: 4716 - protein, 10 aa, Artificial Sequence
  Description of Artificial Sequence:  Synthetic Peptide
LLPEGHLLYI

SEQ ID NO: 4717 - protein, 10 aa, Artificial Sequence
  Description of Artificial Sequence:  Synthetic Peptide
RSPIEGDLTL

SEQ ID NO: 4718 - protein, 10 aa, Artificial Sequence
  Description of Artificial Sequence:  Synthetic Peptide
MAEDQVSPSL

SEQ ID NO: 4719 - protein, 10 aa, Artificial Sequence
  Description of Artificial Sequence:  Synthetic Peptide
TLLPEGHLLY

SEQ ID NO: 4720 - protein, 10 aa, Artificial Sequence
  Description of Artificial Sequence:  Synthetic Peptide
SPIEGDLTLL

SEQ ID NO: 4721 - protein, 10 aa, Artificial Sequence
  Description of Artificial Sequence:  Synthetic Peptide
DVRQGKRSPI

SEQ ID NO: 4722 - protein, 10 aa, Artificial Sequence
  Description of Artificial Sequence:  Synthetic Peptide
DVRQGKRSPI

SEQ ID NO: 4723 - protein, 10 aa, Artificial Sequence
  Description of Artificial Sequence:  Synthetic Peptide
RPRGSGRGQY

SEQ ID NO: 4724 - protein, 10 aa, Artificial Sequence
  Description of Artificial Sequence:  Synthetic Peptide
SPIEGDLTLL

SEQ ID NO: 4725 - protein, 10 aa, Artificial Sequence
  Description of Artificial Sequence:  Synthetic Peptide
RSPIEGDLTL

SEQ ID NO: 4726 - protein, 10 aa, Artificial Sequence
  Description of Artificial Sequence:  Synthetic Peptide
KPQGGSHRGI

SEQ ID NO: 4727 - protein, 9 aa, Artificial Sequence
  Description of Artificial Sequence:  Synthetic Peptide
GLGHSWWCA

SEQ ID NO: 4728 - protein, 9 aa, Artificial Sequence
  Description of Artificial Sequence:  Synthetic Peptide
RPRDDVECF

SEQ ID NO: 4729 - protein, 9 aa, Artificial Sequence
  Description of Artificial Sequence:  Synthetic Peptide
DEVYGLSHA

SEQ ID NO: 4730 - protein, 10 aa, Artificial Sequence
  Description of Artificial Sequence:  Synthetic Peptide
GLGHSWWCAV

SEQ ID NO: 4731 - protein, 10 aa, Artificial Sequence
  Description of Artificial Sequence:  Synthetic Peptide
LVGLGHSWWC

SEQ ID NO: 4732 - protein, 10 aa, Artificial Sequence
  Description of Artificial Sequence:  Synthetic Peptide
CFNGDEVYGL

SEQ ID NO: 4733 - protein, 10 aa, Artificial Sequence
  Description of Artificial Sequence:  Synthetic Peptide
RPRDDVECFN

SEQ ID NO: 4734 - protein, 10 aa, Artificial Sequence
  Description of Artificial Sequence:  Synthetic Peptide
VECFNGDEVY

SEQ ID NO: 4735 - protein, 9 aa, Artificial Sequence
  Description of Artificial Sequence:  Synthetic Peptide
AARWRATSL

SEQ ID NO: 4736 - protein, 9 aa, Artificial Sequence
  Description of Artificial Sequence:  Synthetic Peptide
AARWRATSL

SEQ ID NO: 4737 - protein, 10 aa, Artificial Sequence
  Description of Artificial Sequence:  Synthetic Peptide
GIEVGSNAAR

SEQ ID NO: 4738 - protein, 10 aa, Artificial Sequence
  Description of Artificial Sequence:  Synthetic Peptide
NAARWRATSL

SEQ ID NO: 4739 - protein, 10 aa, Artificial Sequence
  Description of Artificial Sequence:  Synthetic Peptide
NAARWRATSL

SEQ ID NO: 4740 - protein, 10 aa, Artificial Sequence
  Description of Artificial Sequence:  Synthetic Peptide
IEVGSNAARW

SEQ ID NO: 4741 - protein, 9 aa, Artificial Sequence
  Description of Artificial Sequence:  Synthetic Peptide
STNDVYDDL

SEQ ID NO: 4742 - protein, 9 aa, Artificial Sequence
  Description of Artificial Sequence:  Synthetic Peptide
GPRSLHREV

SEQ ID NO: 4743 - protein, 9 aa, Artificial Sequence
  Description of Artificial Sequence:  Synthetic Peptide
APMSSTNDV

SEQ ID NO: 4744 - protein, 9 aa, Artificial Sequence
  Description of Artificial Sequence:  Synthetic Peptide
GPRSLHREV

SEQ ID NO: 4745 - protein, 9 aa, Artificial Sequence
  Description of Artificial Sequence:  Synthetic Peptide
AEHNAPMSS

SEQ ID NO: 4746 - protein, 10 aa, Artificial Sequence
  Description of Artificial Sequence:  Synthetic Peptide
APMSSTNDVY

SEQ ID NO: 4747 - protein, 10 aa, Artificial Sequence
  Description of Artificial Sequence:  Synthetic Peptide
REVGQAEHNA

SEQ ID NO: 4748 - protein, 10 aa, Artificial Sequence
  Description of Artificial Sequence:  Synthetic Peptide
APMSSTNDVY

SEQ ID NO: 4749 - protein, 9 aa, Artificial Sequence
  Description of Artificial Sequence:  Synthetic Peptide
AFLHKPVVL

SEQ ID NO: 4750 - protein, 9 aa, Artificial Sequence
  Description of Artificial Sequence:  Synthetic Peptide
FLHKPVVLR

SEQ ID NO: 4751 - protein, 9 aa, Artificial Sequence
  Description of Artificial Sequence:  Synthetic Peptide
ALREGAALL

SEQ ID NO: 4752 - protein, 9 aa, Artificial Sequence
  Description of Artificial Sequence:  Synthetic Peptide
VLRRDNEHL

SEQ ID NO: 4753 - protein, 9 aa, Artificial Sequence
  Description of Artificial Sequence:  Synthetic Peptide
QALREGAAL

SEQ ID NO: 4754 - protein, 9 aa, Artificial Sequence
  Description of Artificial Sequence:  Synthetic Peptide
ALREGAALL

SEQ ID NO: 4755 - protein, 9 aa, Artificial Sequence
  Description of Artificial Sequence:  Synthetic Peptide
NEHLGCQHY

SEQ ID NO: 4756 - protein, 10 aa, Artificial Sequence
  Description of Artificial Sequence:  Synthetic Peptide
DNEHLGCQHY

SEQ ID NO: 4757 - protein, 10 aa, Artificial Sequence
  Description of Artificial Sequence:  Synthetic Peptide
HVDVRPQALR

SEQ ID NO: 4758 - protein, 10 aa, Artificial Sequence
  Description of Artificial Sequence:  Synthetic Peptide
TQVDGAIAFL

SEQ ID NO: 4759 - protein, 10 aa, Artificial Sequence
  Description of Artificial Sequence:  Synthetic Peptide
FLHKPVVLRR

SEQ ID NO: 4760 - protein, 10 aa, Artificial Sequence
  Description of Artificial Sequence:  Synthetic Peptide
VVLRRDNEHL

SEQ ID NO: 4761 - protein, 10 aa, Artificial Sequence
  Description of Artificial Sequence:  Synthetic Peptide
IAFLHKPVVL

SEQ ID NO: 4762 - protein, 10 aa, Artificial Sequence
  Description of Artificial Sequence:  Synthetic Peptide
QALREGAALL

SEQ ID NO: 4763 - protein, 10 aa, Artificial Sequence
  Description of Artificial Sequence:  Synthetic Peptide
IAFLHKPVVL

SEQ ID NO: 4764 - protein, 10 aa, Artificial Sequence
  Description of Artificial Sequence:  Synthetic Peptide
AEVPHVESRA

SEQ ID NO: 4765 - protein, 9 aa, Artificial Sequence
  Description of Artificial Sequence:  Synthetic Peptide
EPSCPAESL

SEQ ID NO: 4766 - protein, 9 aa, Artificial Sequence
  Description of Artificial Sequence:  Synthetic Peptide
EPSCPAESL

SEQ ID NO: 4767 - protein, 9 aa, Artificial Sequence
  Description of Artificial Sequence:  Synthetic Peptide
RQARVTFQL

SEQ ID NO: 4768 - protein, 9 aa, Artificial Sequence
  Description of Artificial Sequence:  Synthetic Peptide
RQARVTFQL

SEQ ID NO: 4769 - protein, 10 aa, Artificial Sequence
  Description of Artificial Sequence:  Synthetic Peptide
QARVTFQLWL

SEQ ID NO: 4770 - protein, 10 aa, Artificial Sequence
  Description of Artificial Sequence:  Synthetic Peptide
QARVTFQLWL

SEQ ID NO: 4771 - protein, 10 aa, Artificial Sequence
  Description of Artificial Sequence:  Synthetic Peptide
DSRSTPIRTF

SEQ ID NO: 4772 - protein, 10 aa, Artificial Sequence
  Description of Artificial Sequence:  Synthetic Peptide
AEGRRQARVT

SEQ ID NO: 4773 - protein, 10 aa, Artificial Sequence
  Description of Artificial Sequence:  Synthetic Peptide
MLSAPGHIPV

SEQ ID NO: 4774 - protein, 10 aa, Artificial Sequence
  Description of Artificial Sequence:  Synthetic Peptide
MPPSLPEEAF

SEQ ID NO: 4775 - protein, 10 aa, Artificial Sequence
  Description of Artificial Sequence:  Synthetic Peptide
RETPPAGRGS

SEQ ID NO: 4776 - protein, 9 aa, Artificial Sequence
  Description of Artificial Sequence:  Synthetic Peptide
RESPERPLW

SEQ ID NO: 4777 - protein, 10 aa, Artificial Sequence
  Description of Artificial Sequence:  Synthetic Peptide
VLRARGRSFL

SEQ ID NO: 4778 - protein, 10 aa, Artificial Sequence
  Description of Artificial Sequence:  Synthetic Peptide
SGRESPERPL

SEQ ID NO: 4779 - protein, 10 aa, Artificial Sequence
  Description of Artificial Sequence:  Synthetic Peptide
VLRARGRSFL

SEQ ID NO: 4780 - protein, 9 aa, Artificial Sequence
  Description of Artificial Sequence:  Synthetic Peptide
GSPRSLPQM

SEQ ID NO: 4781 - protein, 10 aa, Artificial Sequence
  Description of Artificial Sequence:  Synthetic Peptide
SLPQMGVTPA

SEQ ID NO: 4782 - protein, 10 aa, Artificial Sequence
  Description of Artificial Sequence:  Synthetic Peptide
APIAGSPRSL

SEQ ID NO: 4783 - protein, 10 aa, Artificial Sequence
  Description of Artificial Sequence:  Synthetic Peptide
LPQMGVTPAL

SEQ ID NO: 4784 - protein, 10 aa, Artificial Sequence
  Description of Artificial Sequence:  Synthetic Peptide
SPRSLPQMGV

SEQ ID NO: 4785 - protein, 10 aa, Artificial Sequence
  Description of Artificial Sequence:  Synthetic Peptide
GVTPALSAAL

SEQ ID NO: 4786 - protein, 10 aa, Artificial Sequence
  Description of Artificial Sequence:  Synthetic Peptide
APIAGSPRSL

SEQ ID NO: 4787 - protein, 10 aa, Artificial Sequence
  Description of Artificial Sequence:  Synthetic Peptide
LPQMGVTPAL

SEQ ID NO: 4788 - protein, 10 aa, Artificial Sequence
  Description of Artificial Sequence:  Synthetic Peptide
SPRSLPQMGV

SEQ ID NO: 4789 - protein, 9 aa, Artificial Sequence
  Description of Artificial Sequence:  Synthetic Peptide
APCPGLCCL

SEQ ID NO: 4790 - protein, 9 aa, Artificial Sequence
  Description of Artificial Sequence:  Synthetic Peptide
YPPAPCPGL

SEQ ID NO: 4791 - protein, 9 aa, Artificial Sequence
  Description of Artificial Sequence:  Synthetic Peptide
CPRHTPPGY

SEQ ID NO: 4792 - protein, 9 aa, Artificial Sequence
  Description of Artificial Sequence:  Synthetic Peptide
YPPAPCPGL

SEQ ID NO: 4793 - protein, 9 aa, Artificial Sequence
  Description of Artificial Sequence:  Synthetic Peptide
APCPGLCCL

SEQ ID NO: 4794 - protein, 10 aa, Artificial Sequence
  Description of Artificial Sequence:  Synthetic Peptide
GLCCLQQPPL

SEQ ID NO: 4795 - protein, 10 aa, Artificial Sequence
  Description of Artificial Sequence:  Synthetic Peptide
GYPPAPCPGL

SEQ ID NO: 4796 - protein, 9 aa, Artificial Sequence
  Description of Artificial Sequence:  Synthetic Peptide
KPQQDSLVV

SEQ ID NO: 4797 - protein, 10 aa, Artificial Sequence
  Description of Artificial Sequence:  Synthetic Peptide
KPQQDSLVVL

SEQ ID NO: 4798 - protein, 10 aa, Artificial Sequence
  Description of Artificial Sequence:  Synthetic Peptide
KPQQDSLVVL

SEQ ID NO: 4799 - protein, 10 aa, Artificial Sequence
  Description of Artificial Sequence:  Synthetic Peptide
KPQQDSLVVL

SEQ ID NO: 4800 - protein, 10 aa, Artificial Sequence
  Description of Artificial Sequence:  Synthetic Peptide
LPRPPQLGPT

SEQ ID NO: 4801 - protein, 10 aa, Artificial Sequence
  Description of Artificial Sequence:  Synthetic Peptide
RPPQLGPTCW

SEQ ID NO: 4802 - protein, 9 aa, Artificial Sequence
  Description of Artificial Sequence:  Synthetic Peptide
LFGKGSGHL

SEQ ID NO: 4803 - protein, 10 aa, Artificial Sequence
  Description of Artificial Sequence:  Synthetic Peptide
NSPPIALFGK

SEQ ID NO: 4804 - protein, 10 aa, Artificial Sequence
  Description of Artificial Sequence:  Synthetic Peptide
ALFGKGSGHL

SEQ ID NO: 4805 - protein, 10 aa, Artificial Sequence
  Description of Artificial Sequence:  Synthetic Peptide
ALFGKGSGHL

SEQ ID NO: 4806 - protein, 9 aa, Artificial Sequence
  Description of Artificial Sequence:  Synthetic Peptide
SLNGRRSSV

SEQ ID NO: 4807 - protein, 9 aa, Artificial Sequence
  Description of Artificial Sequence:  Synthetic Peptide
NGRRSSVSL

SEQ ID NO: 4808 - protein, 9 aa, Artificial Sequence
  Description of Artificial Sequence:  Synthetic Peptide
GPPRAHHTF

SEQ ID NO: 4809 - protein, 10 aa, Artificial Sequence
  Description of Artificial Sequence:  Synthetic Peptide
PPRAHHTFSL

SEQ ID NO: 4810 - protein, 10 aa, Artificial Sequence
  Description of Artificial Sequence:  Synthetic Peptide
TLWPPRSSQF

SEQ ID NO: 4811 - protein, 10 aa, Artificial Sequence
  Description of Artificial Sequence:  Synthetic Peptide
AVRGAVGKRA

SEQ ID NO: 4812 - protein, 9 aa, Artificial Sequence
  Description of Artificial Sequence:  Synthetic Peptide
VYRSCPPRL

SEQ ID NO: 4813 - protein, 9 aa, Artificial Sequence
  Description of Artificial Sequence:  Synthetic Peptide
SPPTCKWAL

SEQ ID NO: 4814 - protein, 9 aa, Artificial Sequence
  Description of Artificial Sequence:  Synthetic Peptide
SPPTCKWAL

SEQ ID NO: 4815 - protein, 10 aa, Artificial Sequence
  Description of Artificial Sequence:  Synthetic Peptide
HLSHSPPTCK

SEQ ID NO: 4816 - protein, 10 aa, Artificial Sequence
  Description of Artificial Sequence:  Synthetic Peptide
QVYRSCPPRL

SEQ ID NO: 4817 - protein, 9 aa, Artificial Sequence
  Description of Artificial Sequence:  Synthetic Peptide
GLEAVRHSY

SEQ ID NO: 4818 - protein, 9 aa, Artificial Sequence
  Description of Artificial Sequence:  Synthetic Peptide
GLEAVRHSY

SEQ ID NO: 4819 - protein, 9 aa, Artificial Sequence
  Description of Artificial Sequence:  Synthetic Peptide
MALPGGGGL

SEQ ID NO: 4820 - protein, 9 aa, Artificial Sequence
  Description of Artificial Sequence:  Synthetic Peptide
RSEVFLVVR

SEQ ID NO: 4821 - protein, 9 aa, Artificial Sequence
  Description of Artificial Sequence:  Synthetic Peptide
RLVFLLVFL

SEQ ID NO: 4822 - protein, 9 aa, Artificial Sequence
  Description of Artificial Sequence:  Synthetic Peptide
FLVVRTPNL

SEQ ID NO: 4823 - protein, 9 aa, Artificial Sequence
  Description of Artificial Sequence:  Synthetic Peptide
GYPGFPQDL

SEQ ID NO: 4824 - protein, 9 aa, Artificial Sequence
  Description of Artificial Sequence:  Synthetic Peptide
RLVFLLVFL

SEQ ID NO: 4825 - protein, 9 aa, Artificial Sequence
  Description of Artificial Sequence:  Synthetic Peptide
RSLGMGWRL

SEQ ID NO: 4826 - protein, 9 aa, Artificial Sequence
  Description of Artificial Sequence:  Synthetic Peptide
CGRRLVFLL

SEQ ID NO: 4827 - protein, 9 aa, Artificial Sequence
  Description of Artificial Sequence:  Synthetic Peptide
RVSMTLPTL

SEQ ID NO: 4828 - protein, 9 aa, Artificial Sequence
  Description of Artificial Sequence:  Synthetic Peptide
SCGRRLVFL

SEQ ID NO: 4829 - protein, 9 aa, Artificial Sequence
  Description of Artificial Sequence:  Synthetic Peptide
HPAQPSPSF

SEQ ID NO: 4830 - protein, 9 aa, Artificial Sequence
  Description of Artificial Sequence:  Synthetic Peptide
RSLGMGWRL

SEQ ID NO: 4831 - protein, 9 aa, Artificial Sequence
  Description of Artificial Sequence:  Synthetic Peptide
SEVFLVVRT

SEQ ID NO: 4832 - protein, 10 aa, Artificial Sequence
  Description of Artificial Sequence:  Synthetic Peptide
RGWDRSEVFL

SEQ ID NO: 4833 - protein, 10 aa, Artificial Sequence
  Description of Artificial Sequence:  Synthetic Peptide
NLTSCGRRLV

SEQ ID NO: 4834 - protein, 10 aa, Artificial Sequence
  Description of Artificial Sequence:  Synthetic Peptide
VFLVVRTPNL

SEQ ID NO: 4835 - protein, 10 aa, Artificial Sequence
  Description of Artificial Sequence:  Synthetic Peptide
KPHVRVSMTL

SEQ ID NO: 4836 - protein, 10 aa, Artificial Sequence
  Description of Artificial Sequence:  Synthetic Peptide
PYRGQGYPGF

SEQ ID NO: 4837 - protein, 10 aa, Artificial Sequence
  Description of Artificial Sequence:  Synthetic Peptide
SLGMGWRLPR

SEQ ID NO: 4838 - protein, 10 aa, Artificial Sequence
  Description of Artificial Sequence:  Synthetic Peptide
VVRTPNLGPL

SEQ ID NO: 4839 - protein, 10 aa, Artificial Sequence
  Description of Artificial Sequence:  Synthetic Peptide
KPHVRVSMTL

SEQ ID NO: 4840 - protein, 10 aa, Artificial Sequence
  Description of Artificial Sequence:  Synthetic Peptide
LPRGWDRSEV

SEQ ID NO: 4841 - protein, 10 aa, Artificial Sequence
  Description of Artificial Sequence:  Synthetic Peptide
TLRDLCRGSL

SEQ ID NO: 4842 - protein, 10 aa, Artificial Sequence
  Description of Artificial Sequence:  Synthetic Peptide
LPVERRSLGM

SEQ ID NO: 4843 - protein, 10 aa, Artificial Sequence
  Description of Artificial Sequence:  Synthetic Peptide
EPRGDRSHPA

SEQ ID NO: 4844 - protein, 10 aa, Artificial Sequence
  Description of Artificial Sequence:  Synthetic Peptide
EPRGDRSHPA

SEQ ID NO: 4845 - protein, 10 aa, Artificial Sequence
  Description of Artificial Sequence:  Synthetic Peptide
TLRDLCRGSL

SEQ ID NO: 4846 - protein, 10 aa, Artificial Sequence
  Description of Artificial Sequence:  Synthetic Peptide
LPVERRSLGM

SEQ ID NO: 4847 - protein, 10 aa, Artificial Sequence
  Description of Artificial Sequence:  Synthetic Peptide
KPHVRVSMTL

SEQ ID NO: 4848 - protein, 10 aa, Artificial Sequence
  Description of Artificial Sequence:  Synthetic Peptide
SAKPHVRVSM

SEQ ID NO: 4849 - protein, 10 aa, Artificial Sequence
  Description of Artificial Sequence:  Synthetic Peptide
LPRGWDRSEV

SEQ ID NO: 4850 - protein, 10 aa, Artificial Sequence
  Description of Artificial Sequence:  Synthetic Peptide
VERRSLGMGW

SEQ ID NO: 4851 - protein, 9 aa, Artificial Sequence
  Description of Artificial Sequence:  Synthetic Peptide
YTDPYISKL

SEQ ID NO: 4852 - protein, 9 aa, Artificial Sequence
  Description of Artificial Sequence:  Synthetic Peptide
WMMFPNHEL

SEQ ID NO: 4853 - protein, 9 aa, Artificial Sequence
  Description of Artificial Sequence:  Synthetic Peptide
RVSSWGVYV

SEQ ID NO: 4854 - protein, 9 aa, Artificial Sequence
  Description of Artificial Sequence:  Synthetic Peptide
FLRAEATRV

SEQ ID NO: 4855 - protein, 9 aa, Artificial Sequence
  Description of Artificial Sequence:  Synthetic Peptide
MMFPNHELT

SEQ ID NO: 4856 - protein, 9 aa, Artificial Sequence
  Description of Artificial Sequence:  Synthetic Peptide
RYRPQTAAL

SEQ ID NO: 4857 - protein, 9 aa, Artificial Sequence
  Description of Artificial Sequence:  Synthetic Peptide
RAIGVVGSL

SEQ ID NO: 4858 - protein, 9 aa, Artificial Sequence
  Description of Artificial Sequence:  Synthetic Peptide
GLTEYTDPY

SEQ ID NO: 4859 - protein, 9 aa, Artificial Sequence
  Description of Artificial Sequence:  Synthetic Peptide
SLVFTAQLK

SEQ ID NO: 4860 - protein, 9 aa, Artificial Sequence
  Description of Artificial Sequence:  Synthetic Peptide
PPREMRDAL

SEQ ID NO: 4861 - protein, 9 aa, Artificial Sequence
  Description of Artificial Sequence:  Synthetic Peptide
WMMFPNHEL

SEQ ID NO: 4862 - protein, 9 aa, Artificial Sequence
  Description of Artificial Sequence:  Synthetic Peptide
DALTARARL

SEQ ID NO: 4863 - protein, 9 aa, Artificial Sequence
  Description of Artificial Sequence:  Synthetic Peptide
RAIGVVGSL

SEQ ID NO: 4864 - protein, 9 aa, Artificial Sequence
  Description of Artificial Sequence:  Synthetic Peptide
RASGNGVSL

SEQ ID NO: 4865 - protein, 9 aa, Artificial Sequence
  Description of Artificial Sequence:  Synthetic Peptide
TARARLFHA

SEQ ID NO: 4866 - protein, 9 aa, Artificial Sequence
  Description of Artificial Sequence:  Synthetic Peptide
PPREMRDAL

SEQ ID NO: 4867 - protein, 9 aa, Artificial Sequence
  Description of Artificial Sequence:  Synthetic Peptide
SSPCNLSIM

SEQ ID NO: 4868 - protein, 9 aa, Artificial Sequence
  Description of Artificial Sequence:  Synthetic Peptide
AEATRVSSW

SEQ ID NO: 4869 - protein, 9 aa, Artificial Sequence
  Description of Artificial Sequence:  Synthetic Peptide
MEKKCVIRT

SEQ ID NO: 4870 - protein, 9 aa, Artificial Sequence
  Description of Artificial Sequence:  Synthetic Peptide
REMRDALTA

SEQ ID NO: 4871 - protein, 9 aa, Artificial Sequence
  Description of Artificial Sequence:  Synthetic Peptide
GECLTVSQA

SEQ ID NO: 4872 - protein, 10 aa, Artificial Sequence
  Description of Artificial Sequence:  Synthetic Peptide
YTDPYISKLR

SEQ ID NO: 4873 - protein, 10 aa, Artificial Sequence
  Description of Artificial Sequence:  Synthetic Peptide
GLTEYTDPYI

SEQ ID NO: 4874 - protein, 10 aa, Artificial Sequence
  Description of Artificial Sequence:  Synthetic Peptide
SLSLVFTAQL

SEQ ID NO: 4875 - protein, 10 aa, Artificial Sequence
  Description of Artificial Sequence:  Synthetic Peptide
WMMFPNHELT

SEQ ID NO: 4876 - protein, 10 aa, Artificial Sequence
  Description of Artificial Sequence:  Synthetic Peptide
EYTDPYISKL

SEQ ID NO: 4877 - protein, 10 aa, Artificial Sequence
  Description of Artificial Sequence:  Synthetic Peptide
SLVFTAQLKR

SEQ ID NO: 4878 - protein, 10 aa, Artificial Sequence
  Description of Artificial Sequence:  Synthetic Peptide
ALRGGAPSFL

SEQ ID NO: 4879 - protein, 10 aa, Artificial Sequence
  Description of Artificial Sequence:  Synthetic Peptide
LPPREMRDAL

SEQ ID NO: 4880 - protein, 10 aa, Artificial Sequence
  Description of Artificial Sequence:  Synthetic Peptide
TARARLFHAL

SEQ ID NO: 4881 - protein, 10 aa, Artificial Sequence
  Description of Artificial Sequence:  Synthetic Peptide
AIRMEKKCVI

SEQ ID NO: 4882 - protein, 10 aa, Artificial Sequence
  Description of Artificial Sequence:  Synthetic Peptide
ASGNGVSLSL

SEQ ID NO: 4883 - protein, 10 aa, Artificial Sequence
  Description of Artificial Sequence:  Synthetic Peptide
SIMAGRSRGL

SEQ ID NO: 4884 - protein, 10 aa, Artificial Sequence
  Description of Artificial Sequence:  Synthetic Peptide
WSRVSWAIRM

SEQ ID NO: 4885 - protein, 10 aa, Artificial Sequence
  Description of Artificial Sequence:  Synthetic Peptide
AIRMEKKCVI

SEQ ID NO: 4886 - protein, 10 aa, Artificial Sequence
  Description of Artificial Sequence:  Synthetic Peptide
TARARLFHAL

SEQ ID NO: 4887 - protein, 10 aa, Artificial Sequence
  Description of Artificial Sequence:  Synthetic Peptide
VIRTMRTHIV

SEQ ID NO: 4888 - protein, 10 aa, Artificial Sequence
  Description of Artificial Sequence:  Synthetic Peptide
WSRVSWAIRM

SEQ ID NO: 4889 - protein, 10 aa, Artificial Sequence
  Description of Artificial Sequence:  Synthetic Peptide
LPPREMRDAL

SEQ ID NO: 4890 - protein, 10 aa, Artificial Sequence
  Description of Artificial Sequence:  Synthetic Peptide
ASSPCNLSIM

SEQ ID NO: 4891 - protein, 10 aa, Artificial Sequence
  Description of Artificial Sequence:  Synthetic Peptide
DPYISKLRSW

SEQ ID NO: 4892 - protein, 10 aa, Artificial Sequence
  Description of Artificial Sequence:  Synthetic Peptide
AGRSRGLTEY

SEQ ID NO: 4893 - protein, 9 aa, Artificial Sequence
  Description of Artificial Sequence:  Synthetic Peptide
ALQAARAFT

SEQ ID NO: 4894 - protein, 10 aa, Artificial Sequence
  Description of Artificial Sequence:  Synthetic Peptide
IVGATIPAAL

SEQ ID NO: 4895 - protein, 9 aa, Artificial Sequence
  Description of Artificial Sequence:  Synthetic Peptide
RLYPQVWPL

SEQ ID NO: 4896 - protein, 9 aa, Artificial Sequence
  Description of Artificial Sequence:  Synthetic Peptide
LLLNIGPPT

SEQ ID NO: 4897 - protein, 9 aa, Artificial Sequence
  Description of Artificial Sequence:  Synthetic Peptide
QVWPLLLNI

SEQ ID NO: 4898 - protein, 9 aa, Artificial Sequence
  Description of Artificial Sequence:  Synthetic Peptide
LYPQVWPLL

SEQ ID NO: 4899 - protein, 9 aa, Artificial Sequence
  Description of Artificial Sequence:  Synthetic Peptide
RLYPQVWPL

SEQ ID NO: 4900 - protein, 9 aa, Artificial Sequence
  Description of Artificial Sequence:  Synthetic Peptide
YPQVWPLLL

SEQ ID NO: 4901 - protein, 9 aa, Artificial Sequence
  Description of Artificial Sequence:  Synthetic Peptide
TPLARQRLY

SEQ ID NO: 4902 - protein, 9 aa, Artificial Sequence
  Description of Artificial Sequence:  Synthetic Peptide
YPQVWPLLL

SEQ ID NO: 4903 - protein, 10 aa, Artificial Sequence
  Description of Artificial Sequence:  Synthetic Peptide
RLYPQVWPLL

SEQ ID NO: 4904 - protein, 10 aa, Artificial Sequence
  Description of Artificial Sequence:  Synthetic Peptide
LYPQVWPLLL

SEQ ID NO: 4905 - protein, 10 aa, Artificial Sequence
  Description of Artificial Sequence:  Synthetic Peptide
RLYPQVWPLL

SEQ ID NO: 4906 - protein, 10 aa, Artificial Sequence
  Description of Artificial Sequence:  Synthetic Peptide
MLVVSTPLAR

SEQ ID NO: 4907 - protein, 10 aa, Artificial Sequence
  Description of Artificial Sequence:  Synthetic Peptide
FPMLVVSTPL

SEQ ID NO: 4908 - protein, 10 aa, Artificial Sequence
  Description of Artificial Sequence:  Synthetic Peptide
FPMLVVSTPL

SEQ ID NO: 4909 - protein, 9 aa, Artificial Sequence
  Description of Artificial Sequence:  Synthetic Peptide
VLMSLSVTV

SEQ ID NO: 4910 - protein, 9 aa, Artificial Sequence
  Description of Artificial Sequence:  Synthetic Peptide
SYEKPIGSF

SEQ ID NO: 4911 - protein, 9 aa, Artificial Sequence
  Description of Artificial Sequence:  Synthetic Peptide
WYMASSVLM

SEQ ID NO: 4912 - protein, 9 aa, Artificial Sequence
  Description of Artificial Sequence:  Synthetic Peptide
SLSVTVESK

SEQ ID NO: 4913 - protein, 9 aa, Artificial Sequence
  Description of Artificial Sequence:  Synthetic Peptide
FLSAHAFKR

SEQ ID NO: 4914 - protein, 9 aa, Artificial Sequence
  Description of Artificial Sequence:  Synthetic Peptide
MASSVLMSL

SEQ ID NO: 4915 - protein, 9 aa, Artificial Sequence
  Description of Artificial Sequence:  Synthetic Peptide
SSGKEQAWY

SEQ ID NO: 4916 - protein, 9 aa, Artificial Sequence
  Description of Artificial Sequence:  Synthetic Peptide
SGKEQAWYM

SEQ ID NO: 4917 - protein, 9 aa, Artificial Sequence
  Description of Artificial Sequence:  Synthetic Peptide
NSTRWAGEY

SEQ ID NO: 4918 - protein, 9 aa, Artificial Sequence
  Description of Artificial Sequence:  Synthetic Peptide
VESKHRVSY

SEQ ID NO: 4919 - protein, 10 aa, Artificial Sequence
  Description of Artificial Sequence:  Synthetic Peptide
TVESKHRVSY

SEQ ID NO: 4920 - protein, 10 aa, Artificial Sequence
  Description of Artificial Sequence:  Synthetic Peptide
YMASSVLMSL

SEQ ID NO: 4921 - protein, 10 aa, Artificial Sequence
  Description of Artificial Sequence:  Synthetic Peptide
SVLMSLSVTV

SEQ ID NO: 4922 - protein, 10 aa, Artificial Sequence
  Description of Artificial Sequence:  Synthetic Peptide
SYEKPIGSFL

SEQ ID NO: 4923 - protein, 10 aa, Artificial Sequence
  Description of Artificial Sequence:  Synthetic Peptide
QAWYMASSVL

SEQ ID NO: 4924 - protein, 10 aa, Artificial Sequence
  Description of Artificial Sequence:  Synthetic Peptide
ASSGKEQAWY

SEQ ID NO: 4925 - protein, 10 aa, Artificial Sequence
  Description of Artificial Sequence:  Synthetic Peptide
SSGKEQAWYM

SEQ ID NO: 4926 - protein, 10 aa, Artificial Sequence
  Description of Artificial Sequence:  Synthetic Peptide
VSYEKPIGSF

SEQ ID NO: 4927 - protein, 10 aa, Artificial Sequence
  Description of Artificial Sequence:  Synthetic Peptide
YEKPIGSFLS

SEQ ID NO: 4928 - protein, 9 aa, Artificial Sequence
  Description of Artificial Sequence:  Synthetic Peptide
WLTALPDKL

SEQ ID NO: 4929 - protein, 9 aa, Artificial Sequence
  Description of Artificial Sequence:  Synthetic Peptide
ALTLEAASL

SEQ ID NO: 4930 - protein, 9 aa, Artificial Sequence
  Description of Artificial Sequence:  Synthetic Peptide
SFHTDLMWL

SEQ ID NO: 4931 - protein, 9 aa, Artificial Sequence
  Description of Artificial Sequence:  Synthetic Peptide
KLRTSLAPY

SEQ ID NO: 4932 - protein, 9 aa, Artificial Sequence
  Description of Artificial Sequence:  Synthetic Peptide
KVRSFALTL

SEQ ID NO: 4933 - protein, 9 aa, Artificial Sequence
  Description of Artificial Sequence:  Synthetic Peptide
LPDKLRTSL

SEQ ID NO: 4934 - protein, 9 aa, Artificial Sequence
  Description of Artificial Sequence:  Synthetic Peptide
LAPYPYLDL

SEQ ID NO: 4935 - protein, 9 aa, Artificial Sequence
  Description of Artificial Sequence:  Synthetic Peptide
ALTLEAASL

SEQ ID NO: 4936 - protein, 9 aa, Artificial Sequence
  Description of Artificial Sequence:  Synthetic Peptide
SSKVRSFAL

SEQ ID NO: 4937 - protein, 9 aa, Artificial Sequence
  Description of Artificial Sequence:  Synthetic Peptide
SSKVRSFAL

SEQ ID NO: 4938 - protein, 9 aa, Artificial Sequence
  Description of Artificial Sequence:  Synthetic Peptide
YPYLDLAEW

SEQ ID NO: 4939 - protein, 9 aa, Artificial Sequence
  Description of Artificial Sequence:  Synthetic Peptide
KLRTSLAPY

SEQ ID NO: 4940 - protein, 9 aa, Artificial Sequence
  Description of Artificial Sequence:  Synthetic Peptide
LEAASLMSF

SEQ ID NO: 4941 - protein, 10 aa, Artificial Sequence
  Description of Artificial Sequence:  Synthetic Peptide
TLEAASLMSF

SEQ ID NO: 4942 - protein, 10 aa, Artificial Sequence
  Description of Artificial Sequence:  Synthetic Peptide
ALPDKLRTSL

SEQ ID NO: 4943 - protein, 10 aa, Artificial Sequence
  Description of Artificial Sequence:  Synthetic Peptide
SLAPYPYLDL

SEQ ID NO: 4944 - protein, 10 aa, Artificial Sequence
  Description of Artificial Sequence:  Synthetic Peptide
YLDLAEWGGV

SEQ ID NO: 4945 - protein, 10 aa, Artificial Sequence
  Description of Artificial Sequence:  Synthetic Peptide
LMWLTALPDK

SEQ ID NO: 4946 - protein, 10 aa, Artificial Sequence
  Description of Artificial Sequence:  Synthetic Peptide
SSRRSFHTDL

SEQ ID NO: 4947 - protein, 10 aa, Artificial Sequence
  Description of Artificial Sequence:  Synthetic Peptide
ALPDKLRTSL

SEQ ID NO: 4948 - protein, 10 aa, Artificial Sequence
  Description of Artificial Sequence:  Synthetic Peptide
FALTLEAASL

SEQ ID NO: 4949 - protein, 10 aa, Artificial Sequence
  Description of Artificial Sequence:  Synthetic Peptide
ASSKVRSFAL

SEQ ID NO: 4950 - protein, 10 aa, Artificial Sequence
  Description of Artificial Sequence:  Synthetic Peptide
RSFHTDLMWL

SEQ ID NO: 4951 - protein, 10 aa, Artificial Sequence
  Description of Artificial Sequence:  Synthetic Peptide
SSRRSFHTDL

SEQ ID NO: 4952 - protein, 10 aa, Artificial Sequence
  Description of Artificial Sequence:  Synthetic Peptide
AEWGGVNWHA

SEQ ID NO: 4953 - protein, 9 aa, Artificial Sequence
  Description of Artificial Sequence:  Synthetic Peptide
RLLGGGVGV

SEQ ID NO: 4954 - protein, 9 aa, Artificial Sequence
  Description of Artificial Sequence:  Synthetic Peptide
VLMASCWRA

SEQ ID NO: 4955 - protein, 9 aa, Artificial Sequence
  Description of Artificial Sequence:  Synthetic Peptide
MVLSLRPTV

SEQ ID NO: 4956 - protein, 9 aa, Artificial Sequence
  Description of Artificial Sequence:  Synthetic Peptide
SLRPTVRRL

SEQ ID NO: 4957 - protein, 9 aa, Artificial Sequence
  Description of Artificial Sequence:  Synthetic Peptide
EPGAASPPW

SEQ ID NO: 4958 - protein, 9 aa, Artificial Sequence
  Description of Artificial Sequence:  Synthetic Peptide
ASCWRASPM

SEQ ID NO: 4959 - protein, 9 aa, Artificial Sequence
  Description of Artificial Sequence:  Synthetic Peptide
WEGGRSSTW

SEQ ID NO: 4960 - protein, 10 aa, Artificial Sequence
  Description of Artificial Sequence:  Synthetic Peptide
LLGGGVGVFL

SEQ ID NO: 4961 - protein, 10 aa, Artificial Sequence
  Description of Artificial Sequence:  Synthetic Peptide
KVLMASCWRA

SEQ ID NO: 4962 - protein, 10 aa, Artificial Sequence
  Description of Artificial Sequence:  Synthetic Peptide
FLGGGRAQPA

SEQ ID NO: 4963 - protein, 10 aa, Artificial Sequence
  Description of Artificial Sequence:  Synthetic Peptide
APVERPESPL

SEQ ID NO: 4964 - protein, 10 aa, Artificial Sequence
  Description of Artificial Sequence:  Synthetic Peptide
SLRPTVRRLL

SEQ ID NO: 4965 - protein, 10 aa, Artificial Sequence
  Description of Artificial Sequence:  Synthetic Peptide
SPGSPSRGGM

SEQ ID NO: 4966 - protein, 10 aa, Artificial Sequence
  Description of Artificial Sequence:  Synthetic Peptide
TVRRLLGGGV

SEQ ID NO: 4967 - protein, 10 aa, Artificial Sequence
  Description of Artificial Sequence:  Synthetic Peptide
SPGSPSRGGM

SEQ ID NO: 4968 - protein, 10 aa, Artificial Sequence
  Description of Artificial Sequence:  Synthetic Peptide
APVERPESPL

SEQ ID NO: 4969 - protein, 10 aa, Artificial Sequence
  Description of Artificial Sequence:  Synthetic Peptide
WPKVLMASCW

SEQ ID NO: 4970 - protein, 10 aa, Artificial Sequence
  Description of Artificial Sequence:  Synthetic Peptide
SEPGAASPPW

SEQ ID NO: 4971 - protein, 10 aa, Artificial Sequence
  Description of Artificial Sequence:  Synthetic Peptide
EEVEPVSERA

SEQ ID NO: 4972 - protein, 9 aa, Artificial Sequence
  Description of Artificial Sequence:  Synthetic Peptide
MLAPQGHRV

SEQ ID NO: 4973 - protein, 9 aa, Artificial Sequence
  Description of Artificial Sequence:  Synthetic Peptide
VMMPVPAHT

SEQ ID NO: 4974 - protein, 9 aa, Artificial Sequence
  Description of Artificial Sequence:  Synthetic Peptide
APQGHRVVM

SEQ ID NO: 4975 - protein, 9 aa, Artificial Sequence
  Description of Artificial Sequence:  Synthetic Peptide
MPVPAHTPL

SEQ ID NO: 4976 - protein, 9 aa, Artificial Sequence
  Description of Artificial Sequence:  Synthetic Peptide
APQGHRVVM

SEQ ID NO: 4977 - protein, 9 aa, Artificial Sequence
  Description of Artificial Sequence:  Synthetic Peptide
MPVPAHTPL

SEQ ID NO: 4978 - protein, 10 aa, Artificial Sequence
  Description of Artificial Sequence:  Synthetic Peptide
MMPVPAHTPL

SEQ ID NO: 4979 - protein, 10 aa, Artificial Sequence
  Description of Artificial Sequence:  Synthetic Peptide
APQGHRVVMM

SEQ ID NO: 4980 - protein, 10 aa, Artificial Sequence
  Description of Artificial Sequence:  Synthetic Peptide
APQGHRVVMM

SEQ ID NO: 4981 - protein, 9 aa, Artificial Sequence
  Description of Artificial Sequence:  Synthetic Peptide
QLWSLLSRL

SEQ ID NO: 4982 - protein, 9 aa, Artificial Sequence
  Description of Artificial Sequence:  Synthetic Peptide
SLLSRLVIV

SEQ ID NO: 4983 - protein, 9 aa, Artificial Sequence
  Description of Artificial Sequence:  Synthetic Peptide
IVREPSSWV

SEQ ID NO: 4984 - protein, 9 aa, Artificial Sequence
  Description of Artificial Sequence:  Synthetic Peptide
LLSRLVIVR

SEQ ID NO: 4985 - protein, 9 aa, Artificial Sequence
  Description of Artificial Sequence:  Synthetic Peptide
SVIQLWSLL

SEQ ID NO: 4986 - protein, 9 aa, Artificial Sequence
  Description of Artificial Sequence:  Synthetic Peptide
IVREPSSWV

SEQ ID NO: 4987 - protein, 9 aa, Artificial Sequence
  Description of Artificial Sequence:  Synthetic Peptide
RSHEPAHGM

SEQ ID NO: 4988 - protein, 10 aa, Artificial Sequence
  Description of Artificial Sequence:  Synthetic Peptide
QLWSLLSRLV

SEQ ID NO: 4989 - protein, 10 aa, Artificial Sequence
  Description of Artificial Sequence:  Synthetic Peptide
VIVREPSSWV

SEQ ID NO: 4990 - protein, 10 aa, Artificial Sequence
  Description of Artificial Sequence:  Synthetic Peptide
GMGQSSVIQL

SEQ ID NO: 4991 - protein, 10 aa, Artificial Sequence
  Description of Artificial Sequence:  Synthetic Peptide
IQLWSLLSRL

SEQ ID NO: 4992 - protein, 10 aa, Artificial Sequence
  Description of Artificial Sequence:  Synthetic Peptide
SLLSRLVIVR

SEQ ID NO: 4993 - protein, 10 aa, Artificial Sequence
  Description of Artificial Sequence:  Synthetic Peptide
GMGQSSVIQL

SEQ ID NO: 4994 - protein, 10 aa, Artificial Sequence
  Description of Artificial Sequence:  Synthetic Peptide
REPSSWVTRC

SEQ ID NO: 4995 - protein, 9 aa, Artificial Sequence
  Description of Artificial Sequence:  Synthetic Peptide
RMLRRIVVL

SEQ ID NO: 4996 - protein, 9 aa, Artificial Sequence
  Description of Artificial Sequence:  Synthetic Peptide
MLRRIVVLV

SEQ ID NO: 4997 - protein, 9 aa, Artificial Sequence
  Description of Artificial Sequence:  Synthetic Peptide
TLPRPMLPT

SEQ ID NO: 4998 - protein, 9 aa, Artificial Sequence
  Description of Artificial Sequence:  Synthetic Peptide
RMPAQMTPT

SEQ ID NO: 4999 - protein, 9 aa, Artificial Sequence
  Description of Artificial Sequence:  Synthetic Peptide
RMLRRIVVL

SEQ ID NO: 5000 - protein, 9 aa, Artificial Sequence
  Description of Artificial Sequence:  Synthetic Peptide
IVVLVDNGL

SEQ ID NO: 5001 - protein, 9 aa, Artificial Sequence
  Description of Artificial Sequence:  Synthetic Peptide
VLVDNGLVR

SEQ ID NO: 5002 - protein, 9 aa, Artificial Sequence
  Description of Artificial Sequence:  Synthetic Peptide
IVVLVDNGL

SEQ ID NO: 5003 - protein, 9 aa, Artificial Sequence
  Description of Artificial Sequence:  Synthetic Peptide
LPRPMLPTA

SEQ ID NO: 5004 - protein, 9 aa, Artificial Sequence
  Description of Artificial Sequence:  Synthetic Peptide
LVRAALNAI

SEQ ID NO: 5005 - protein, 9 aa, Artificial Sequence
  Description of Artificial Sequence:  Synthetic Peptide
DASQPPRML

SEQ ID NO: 5006 - protein, 9 aa, Artificial Sequence
  Description of Artificial Sequence:  Synthetic Peptide
PARISTSTL

SEQ ID NO: 5007 - protein, 9 aa, Artificial Sequence
  Description of Artificial Sequence:  Synthetic Peptide
GSRLMTSSM

SEQ ID NO: 5008 - protein, 9 aa, Artificial Sequence
  Description of Artificial Sequence:  Synthetic Peptide
GSRLMTSSM

SEQ ID NO: 5009 - protein, 9 aa, Artificial Sequence
  Description of Artificial Sequence:  Synthetic Peptide
RAPEMPAPY

SEQ ID NO: 5010 - protein, 9 aa, Artificial Sequence
  Description of Artificial Sequence:  Synthetic Peptide
GSVDSPARY

SEQ ID NO: 5011 - protein, 10 aa, Artificial Sequence
  Description of Artificial Sequence:  Synthetic Peptide
RMLRRIVVLV

SEQ ID NO: 5012 - protein, 10 aa, Artificial Sequence
  Description of Artificial Sequence:  Synthetic Peptide
VLVDNGLVRA

SEQ ID NO: 5013 - protein, 10 aa, Artificial Sequence
  Description of Artificial Sequence:  Synthetic Peptide
GLVRAALNAI

SEQ ID NO: 5014 - protein, 10 aa, Artificial Sequence
  Description of Artificial Sequence:  Synthetic Peptide
TLPRPMLPTA

SEQ ID NO: 5015 - protein, 10 aa, Artificial Sequence
  Description of Artificial Sequence:  Synthetic Peptide
RIVVLVDNGL

SEQ ID NO: 5016 - protein, 10 aa, Artificial Sequence
  Description of Artificial Sequence:  Synthetic Peptide
LPTAAPTRPL

SEQ ID NO: 5017 - protein, 10 aa, Artificial Sequence
  Description of Artificial Sequence:  Synthetic Peptide
YPARISTSTL

SEQ ID NO: 5018 - protein, 10 aa, Artificial Sequence
  Description of Artificial Sequence:  Synthetic Peptide
LVRAALNAIM

SEQ ID NO: 5019 - protein, 10 aa, Artificial Sequence
  Description of Artificial Sequence:  Synthetic Peptide
SPGPTWRRRM

SEQ ID NO: 5020 - protein, 10 aa, Artificial Sequence
  Description of Artificial Sequence:  Synthetic Peptide
LPRPMLPTAA

SEQ ID NO: 5021 - protein, 10 aa, Artificial Sequence
  Description of Artificial Sequence:  Synthetic Peptide
SPGPTWRRRM

SEQ ID NO: 5022 - protein, 10 aa, Artificial Sequence
  Description of Artificial Sequence:  Synthetic Peptide
YPARISTSTL

SEQ ID NO: 5023 - protein, 10 aa, Artificial Sequence
  Description of Artificial Sequence:  Synthetic Peptide
LPTAAPTRPL

SEQ ID NO: 5024 - protein, 10 aa, Artificial Sequence
  Description of Artificial Sequence:  Synthetic Peptide
SSMEGFSPDM

SEQ ID NO: 5025 - protein, 10 aa, Artificial Sequence
  Description of Artificial Sequence:  Synthetic Peptide
KPVAPAGGAI

SEQ ID NO: 5026 - protein, 10 aa, Artificial Sequence
  Description of Artificial Sequence:  Synthetic Peptide
ISTSTLPRPM

SEQ ID NO: 5027 - protein, 10 aa, Artificial Sequence
  Description of Artificial Sequence:  Synthetic Peptide
NAIMEATAGF

SEQ ID NO: 5028 - protein, 9 aa, Artificial Sequence
  Description of Artificial Sequence:  Synthetic Peptide
WILDFSISA

SEQ ID NO: 5029 - protein, 9 aa, Artificial Sequence
  Description of Artificial Sequence:  Synthetic Peptide
CLAQNCSTL

SEQ ID NO: 5030 - protein, 9 aa, Artificial Sequence
  Description of Artificial Sequence:  Synthetic Peptide
ILDFSISAI

SEQ ID NO: 5031 - protein, 9 aa, Artificial Sequence
  Description of Artificial Sequence:  Synthetic Peptide
KPWILDFSI

SEQ ID NO: 5032 - protein, 9 aa, Artificial Sequence
  Description of Artificial Sequence:  Synthetic Peptide
CPSSMRAAL

SEQ ID NO: 5033 - protein, 9 aa, Artificial Sequence
  Description of Artificial Sequence:  Synthetic Peptide
ACCNKPWIL

SEQ ID NO: 5034 - protein, 9 aa, Artificial Sequence
  Description of Artificial Sequence:  Synthetic Peptide
AGCMSWACL

SEQ ID NO: 5035 - protein, 9 aa, Artificial Sequence
  Description of Artificial Sequence:  Synthetic Peptide
ACCNKPWIL

SEQ ID NO: 5036 - protein, 9 aa, Artificial Sequence
  Description of Artificial Sequence:  Synthetic Peptide
CPSSMRAAL

SEQ ID NO: 5037 - protein, 9 aa, Artificial Sequence
  Description of Artificial Sequence:  Synthetic Peptide
KPWILDFSI

SEQ ID NO: 5038 - protein, 9 aa, Artificial Sequence
  Description of Artificial Sequence:  Synthetic Peptide
LEACCNKPW

SEQ ID NO: 5039 - protein, 9 aa, Artificial Sequence
  Description of Artificial Sequence:  Synthetic Peptide
HEASTAGCM

SEQ ID NO: 5040 - protein, 10 aa, Artificial Sequence
  Description of Artificial Sequence:  Synthetic Peptide
ILDFSISAIR

SEQ ID NO: 5041 - protein, 10 aa, Artificial Sequence
  Description of Artificial Sequence:  Synthetic Peptide
WILDFSISAI

SEQ ID NO: 5042 - protein, 10 aa, Artificial Sequence
  Description of Artificial Sequence:  Synthetic Peptide
RCPSSMRAAL

SEQ ID NO: 5043 - protein, 10 aa, Artificial Sequence
  Description of Artificial Sequence:  Synthetic Peptide
MPLMKFHMCL

SEQ ID NO: 5044 - protein, 10 aa, Artificial Sequence
  Description of Artificial Sequence:  Synthetic Peptide
TAGCMSWACL

SEQ ID NO: 5045 - protein, 10 aa, Artificial Sequence
  Description of Artificial Sequence:  Synthetic Peptide
EACCNKPWIL

SEQ ID NO: 5046 - protein, 10 aa, Artificial Sequence
  Description of Artificial Sequence:  Synthetic Peptide
EACCNKPWIL

SEQ ID NO: 5047 - protein, 10 aa, Artificial Sequence
  Description of Artificial Sequence:  Synthetic Peptide
MPLMKFHMCL

SEQ ID NO: 5048 - protein, 10 aa, Artificial Sequence
  Description of Artificial Sequence:  Synthetic Peptide
ISAIRCPSSM

SEQ ID NO: 5049 - protein, 10 aa, Artificial Sequence
  Description of Artificial Sequence:  Synthetic Peptide
HEASTAGCMS

SEQ ID NO: 5050 - protein, 9 aa, Artificial Sequence
  Description of Artificial Sequence:  Synthetic Peptide
VTEPKRYRR

SEQ ID NO: 5051 - protein, 9 aa, Artificial Sequence
  Description of Artificial Sequence:  Synthetic Peptide
MMETHPVAK

SEQ ID NO: 5052 - protein, 9 aa, Artificial Sequence
  Description of Artificial Sequence:  Synthetic Peptide
ETHPVAKQY

SEQ ID NO: 5053 - protein, 9 aa, Artificial Sequence
  Description of Artificial Sequence:  Synthetic Peptide
CMHVAMYFV

SEQ ID NO: 5054 - protein, 9 aa, Artificial Sequence
  Description of Artificial Sequence:  Synthetic Peptide
AMYFVTGCV

SEQ ID NO: 5055 - protein, 9 aa, Artificial Sequence
  Description of Artificial Sequence:  Synthetic Peptide
RYRRGVGPT

SEQ ID NO: 5056 - protein, 9 aa, Artificial Sequence
  Description of Artificial Sequence:  Synthetic Peptide
MMETHPVAK

SEQ ID NO: 5057 - protein, 9 aa, Artificial Sequence
  Description of Artificial Sequence:  Synthetic Peptide
TPPARTHVL

SEQ ID NO: 5058 - protein, 9 aa, Artificial Sequence
  Description of Artificial Sequence:  Synthetic Peptide
GVGPTRVGL

SEQ ID NO: 5059 - protein, 9 aa, Artificial Sequence
  Description of Artificial Sequence:  Synthetic Peptide
RPMMETHPV

SEQ ID NO: 5060 - protein, 9 aa, Artificial Sequence
  Description of Artificial Sequence:  Synthetic Peptide
LSRVRHFHM

SEQ ID NO: 5061 - protein, 9 aa, Artificial Sequence
  Description of Artificial Sequence:  Synthetic Peptide
LSRVRHFHM

SEQ ID NO: 5062 - protein, 9 aa, Artificial Sequence
  Description of Artificial Sequence:  Synthetic Peptide
TPPARTHVL

SEQ ID NO: 5063 - protein, 9 aa, Artificial Sequence
  Description of Artificial Sequence:  Synthetic Peptide
LSRVRHFHM

SEQ ID NO: 5064 - protein, 9 aa, Artificial Sequence
  Description of Artificial Sequence:  Synthetic Peptide
RSACMHVAM

SEQ ID NO: 5065 - protein, 9 aa, Artificial Sequence
  Description of Artificial Sequence:  Synthetic Peptide
TPPARTHVL

SEQ ID NO: 5066 - protein, 9 aa, Artificial Sequence
  Description of Artificial Sequence:  Synthetic Peptide
EPKRYRRGV

SEQ ID NO: 5067 - protein, 9 aa, Artificial Sequence
  Description of Artificial Sequence:  Synthetic Peptide
RPMMETHPV

SEQ ID NO: 5068 - protein, 9 aa, Artificial Sequence
  Description of Artificial Sequence:  Synthetic Peptide
TSQDGGGAL

SEQ ID NO: 5069 - protein, 9 aa, Artificial Sequence
  Description of Artificial Sequence:  Synthetic Peptide
ETHPVAKQY

SEQ ID NO: 5070 - protein, 9 aa, Artificial Sequence
  Description of Artificial Sequence:  Synthetic Peptide
SACMHVAMY

SEQ ID NO: 5071 - protein, 10 aa, Artificial Sequence
  Description of Artificial Sequence:  Synthetic Peptide
VTEPKRYRRG

SEQ ID NO: 5072 - protein, 10 aa, Artificial Sequence
  Description of Artificial Sequence:  Synthetic Peptide
GLSRVRHFHM

SEQ ID NO: 5073 - protein, 10 aa, Artificial Sequence
  Description of Artificial Sequence:  Synthetic Peptide
ACMHVAMYFV

SEQ ID NO: 5074 - protein, 10 aa, Artificial Sequence
  Description of Artificial Sequence:  Synthetic Peptide
CMHVAMYFVT

SEQ ID NO: 5075 - protein, 10 aa, Artificial Sequence
  Description of Artificial Sequence:  Synthetic Peptide
KTPPARTHVL

SEQ ID NO: 5076 - protein, 10 aa, Artificial Sequence
  Description of Artificial Sequence:  Synthetic Peptide
RGVGPTRVGL

SEQ ID NO: 5077 - protein, 10 aa, Artificial Sequence
  Description of Artificial Sequence:  Synthetic Peptide
AMYFVTGCVK

SEQ ID NO: 5078 - protein, 10 aa, Artificial Sequence
  Description of Artificial Sequence:  Synthetic Peptide
RSACMHVAMY

SEQ ID NO: 5079 - protein, 10 aa, Artificial Sequence
  Description of Artificial Sequence:  Synthetic Peptide
RSACMHVAMY

SEQ ID NO: 5080 - protein, 10 aa, Artificial Sequence
  Description of Artificial Sequence:  Synthetic Peptide
TSLVTEPKRY

SEQ ID NO: 5081 - protein, 10 aa, Artificial Sequence
  Description of Artificial Sequence:  Synthetic Peptide
METHPVAKQY

SEQ ID NO: 5082 - protein, 10 aa, Artificial Sequence
  Description of Artificial Sequence:  Synthetic Peptide
RSACMHVAMY

SEQ ID NO: 5083 - protein, 9 aa, Artificial Sequence
  Description of Artificial Sequence:  Synthetic Peptide
SLTVVSAGV

SEQ ID NO: 5084 - protein, 9 aa, Artificial Sequence
  Description of Artificial Sequence:  Synthetic Peptide
ALSLTVVSA

SEQ ID NO: 5085 - protein, 9 aa, Artificial Sequence
  Description of Artificial Sequence:  Synthetic Peptide
KYALSLTVV

SEQ ID NO: 5086 - protein, 9 aa, Artificial Sequence
  Description of Artificial Sequence:  Synthetic Peptide
KPGVLKYAL

SEQ ID NO: 5087 - protein, 9 aa, Artificial Sequence
  Description of Artificial Sequence:  Synthetic Peptide
GVLKYALSL

SEQ ID NO: 5088 - protein, 9 aa, Artificial Sequence
  Description of Artificial Sequence:  Synthetic Peptide
KPGVLKYAL

SEQ ID NO: 5089 - protein, 9 aa, Artificial Sequence
  Description of Artificial Sequence:  Synthetic Peptide
TGKPGVLKY

SEQ ID NO: 5090 - protein, 10 aa, Artificial Sequence
  Description of Artificial Sequence:  Synthetic Peptide
WSWHTGKPGV

SEQ ID NO: 5091 - protein, 10 aa, Artificial Sequence
  Description of Artificial Sequence:  Synthetic Peptide
KYALSLTVVS

SEQ ID NO: 5092 - protein, 10 aa, Artificial Sequence
  Description of Artificial Sequence:  Synthetic Peptide
HTGKPGVLKY

SEQ ID NO: 5093 - protein, 9 aa, Artificial Sequence
  Description of Artificial Sequence:  Synthetic Peptide
FEWQKIKCL

SEQ ID NO: 5094 - protein, 9 aa, Artificial Sequence
  Description of Artificial Sequence:  Synthetic Peptide
KIKCLPPLM

SEQ ID NO: 5095 - protein, 10 aa, Artificial Sequence
  Description of Artificial Sequence:  Synthetic Peptide
FFEWQKIKCL

SEQ ID NO: 5096 - protein, 9 aa, Artificial Sequence
  Description of Artificial Sequence:  Synthetic Peptide
MPRMVVAST

SEQ ID NO: 5097 - protein, 10 aa, Artificial Sequence
  Description of Artificial Sequence:  Synthetic Peptide
MPRMVVASTA

SEQ ID NO: 5098 - protein, 10 aa, Artificial Sequence
  Description of Artificial Sequence:  Synthetic Peptide
ASTAWHSSHM

SEQ ID NO: 5099 - protein, 9 aa, Artificial Sequence
  Description of Artificial Sequence:  Synthetic Peptide
GLMPCALDK

SEQ ID NO: 5100 - protein, 9 aa, Artificial Sequence
  Description of Artificial Sequence:  Synthetic Peptide
TLVLFPLPV

SEQ ID NO: 5101 - protein, 9 aa, Artificial Sequence
  Description of Artificial Sequence:  Synthetic Peptide
TLYPWAAYA

SEQ ID NO: 5102 - protein, 9 aa, Artificial Sequence
  Description of Artificial Sequence:  Synthetic Peptide
VLMLGLMPC

SEQ ID NO: 5103 - protein, 9 aa, Artificial Sequence
  Description of Artificial Sequence:  Synthetic Peptide
LMLGLMPCA

SEQ ID NO: 5104 - protein, 9 aa, Artificial Sequence
  Description of Artificial Sequence:  Synthetic Peptide
MLGLMPCAL

SEQ ID NO: 5105 - protein, 9 aa, Artificial Sequence
  Description of Artificial Sequence:  Synthetic Peptide
VLFPLPVGA

SEQ ID NO: 5106 - protein, 9 aa, Artificial Sequence
  Description of Artificial Sequence:  Synthetic Peptide
TVLTPVLML

SEQ ID NO: 5107 - protein, 9 aa, Artificial Sequence
  Description of Artificial Sequence:  Synthetic Peptide
AYATGTLVL

SEQ ID NO: 5108 - protein, 9 aa, Artificial Sequence
  Description of Artificial Sequence:  Synthetic Peptide
KYAPNPRVA

SEQ ID NO: 5109 - protein, 9 aa, Artificial Sequence
  Description of Artificial Sequence:  Synthetic Peptide
GLMPCALDK

SEQ ID NO: 5110 - protein, 9 aa, Artificial Sequence
  Description of Artificial Sequence:  Synthetic Peptide
TVLTPVLML

SEQ ID NO: 5111 - protein, 9 aa, Artificial Sequence
  Description of Artificial Sequence:  Synthetic Peptide
VVTVLTPVL

SEQ ID NO: 5112 - protein, 9 aa, Artificial Sequence
  Description of Artificial Sequence:  Synthetic Peptide
TPVLMLGLM

SEQ ID NO: 5113 - protein, 9 aa, Artificial Sequence
  Description of Artificial Sequence:  Synthetic Peptide
WAAYATGTL

SEQ ID NO: 5114 - protein, 9 aa, Artificial Sequence
  Description of Artificial Sequence:  Synthetic Peptide
MAAPVVTVL

SEQ ID NO: 5115 - protein, 9 aa, Artificial Sequence
  Description of Artificial Sequence:  Synthetic Peptide
TPVLMLGLM

SEQ ID NO: 5116 - protein, 9 aa, Artificial Sequence
  Description of Artificial Sequence:  Synthetic Peptide
STLYPWAAY

SEQ ID NO: 5117 - protein, 10 aa, Artificial Sequence
  Description of Artificial Sequence:  Synthetic Peptide
LMLGLMPCAL

SEQ ID NO: 5118 - protein, 10 aa, Artificial Sequence
  Description of Artificial Sequence:  Synthetic Peptide
VLTPVLMLGL

SEQ ID NO: 5119 - protein, 10 aa, Artificial Sequence
  Description of Artificial Sequence:  Synthetic Peptide
VLMLGLMPCA

SEQ ID NO: 5120 - protein, 10 aa, Artificial Sequence
  Description of Artificial Sequence:  Synthetic Peptide
LMPCALDKYA

SEQ ID NO: 5121 - protein, 10 aa, Artificial Sequence
  Description of Artificial Sequence:  Synthetic Peptide
TLYPWAAYAT

SEQ ID NO: 5122 - protein, 10 aa, Artificial Sequence
  Description of Artificial Sequence:  Synthetic Peptide
GTLVLFPLPV

SEQ ID NO: 5123 - protein, 10 aa, Artificial Sequence
  Description of Artificial Sequence:  Synthetic Peptide
AYATGTLVLF

SEQ ID NO: 5124 - protein, 10 aa, Artificial Sequence
  Description of Artificial Sequence:  Synthetic Peptide
KYAPNPRVAA

SEQ ID NO: 5125 - protein, 10 aa, Artificial Sequence
  Description of Artificial Sequence:  Synthetic Peptide
GLMPCALDKY

SEQ ID NO: 5126 - protein, 10 aa, Artificial Sequence
  Description of Artificial Sequence:  Synthetic Peptide
NPRVAATEGL

SEQ ID NO: 5127 - protein, 10 aa, Artificial Sequence
  Description of Artificial Sequence:  Synthetic Peptide
AAYATGTLVL

SEQ ID NO: 5128 - protein, 10 aa, Artificial Sequence
  Description of Artificial Sequence:  Synthetic Peptide
APVVTVLTPV

SEQ ID NO: 5129 - protein, 10 aa, Artificial Sequence
  Description of Artificial Sequence:  Synthetic Peptide
ATGTLVLFPL

SEQ ID NO: 5130 - protein, 10 aa, Artificial Sequence
  Description of Artificial Sequence:  Synthetic Peptide
NPRVAATEGL

SEQ ID NO: 5131 - protein, 10 aa, Artificial Sequence
  Description of Artificial Sequence:  Synthetic Peptide
NPRVAATEGL

SEQ ID NO: 5132 - protein, 10 aa, Artificial Sequence
  Description of Artificial Sequence:  Synthetic Peptide
FPLPVGACKY

SEQ ID NO: 5133 - protein, 10 aa, Artificial Sequence
  Description of Artificial Sequence:  Synthetic Peptide
TSTLYPWAAY

SEQ ID NO: 5134 - protein, 10 aa, Artificial Sequence
  Description of Artificial Sequence:  Synthetic Peptide
TEGLSTSTLY

SEQ ID NO: 5135 - protein, 10 aa, Artificial Sequence
  Description of Artificial Sequence:  Synthetic Peptide
FPLPVGACKY

SEQ ID NO: 5136 - protein, 9 aa, Artificial Sequence
  Description of Artificial Sequence:  Synthetic Peptide
GPPEDPFKV

SEQ ID NO: 5137 - protein, 9 aa, Artificial Sequence
  Description of Artificial Sequence:  Synthetic Peptide
GLGESNAPR

SEQ ID NO: 5138 - protein, 9 aa, Artificial Sequence
  Description of Artificial Sequence:  Synthetic Peptide
GPREPARVL

SEQ ID NO: 5139 - protein, 9 aa, Artificial Sequence
  Description of Artificial Sequence:  Synthetic Peptide
HPTKSPSAL

SEQ ID NO: 5140 - protein, 9 aa, Artificial Sequence
  Description of Artificial Sequence:  Synthetic Peptide
DPFKVERGL

SEQ ID NO: 5141 - protein, 9 aa, Artificial Sequence
  Description of Artificial Sequence:  Synthetic Peptide
SPRLRAGMT

SEQ ID NO: 5142 - protein, 9 aa, Artificial Sequence
  Description of Artificial Sequence:  Synthetic Peptide
NAPRLSPRL

SEQ ID NO: 5143 - protein, 9 aa, Artificial Sequence
  Description of Artificial Sequence:  Synthetic Peptide
SPRLRAGMT

SEQ ID NO: 5144 - protein, 9 aa, Artificial Sequence
  Description of Artificial Sequence:  Synthetic Peptide
SPRLRAGMT

SEQ ID NO: 5145 - protein, 9 aa, Artificial Sequence
  Description of Artificial Sequence:  Synthetic Peptide
GPREPARVL

SEQ ID NO: 5146 - protein, 9 aa, Artificial Sequence
  Description of Artificial Sequence:  Synthetic Peptide
DPFKVERGL

SEQ ID NO: 5147 - protein, 9 aa, Artificial Sequence
  Description of Artificial Sequence:  Synthetic Peptide
HPTKSPSAL

SEQ ID NO: 5148 - protein, 9 aa, Artificial Sequence
  Description of Artificial Sequence:  Synthetic Peptide
GPPEDPFKV

SEQ ID NO: 5149 - protein, 9 aa, Artificial Sequence
  Description of Artificial Sequence:  Synthetic Peptide
TSAFRVTRY

SEQ ID NO: 5150 - protein, 9 aa, Artificial Sequence
  Description of Artificial Sequence:  Synthetic Peptide
LSPRLRAGM

SEQ ID NO: 5151 - protein, 9 aa, Artificial Sequence
  Description of Artificial Sequence:  Synthetic Peptide
TSAFRVTRY

SEQ ID NO: 5152 - protein, 9 aa, Artificial Sequence
  Description of Artificial Sequence:  Synthetic Peptide
REHTAARKI

SEQ ID NO: 5153 - protein, 10 aa, Artificial Sequence
  Description of Artificial Sequence:  Synthetic Peptide
STGPPEDPFK

SEQ ID NO: 5154 - protein, 10 aa, Artificial Sequence
  Description of Artificial Sequence:  Synthetic Peptide
GLGESNAPRL

SEQ ID NO: 5155 - protein, 10 aa, Artificial Sequence
  Description of Artificial Sequence:  Synthetic Peptide
GMTSAFRVTR

SEQ ID NO: 5156 - protein, 10 aa, Artificial Sequence
  Description of Artificial Sequence:  Synthetic Peptide
GPREPARVLL

SEQ ID NO: 5157 - protein, 10 aa, Artificial Sequence
  Description of Artificial Sequence:  Synthetic Peptide
APHEHGSKDL

SEQ ID NO: 5158 - protein, 10 aa, Artificial Sequence
  Description of Artificial Sequence:  Synthetic Peptide
APRLSPRLRA

SEQ ID NO: 5159 - protein, 10 aa, Artificial Sequence
  Description of Artificial Sequence:  Synthetic Peptide
ASTGMKSMDL

SEQ ID NO: 5160 - protein, 10 aa, Artificial Sequence
  Description of Artificial Sequence:  Synthetic Peptide
GPREPARVLL

SEQ ID NO: 5161 - protein, 10 aa, Artificial Sequence
  Description of Artificial Sequence:  Synthetic Peptide
GPREPARVLL

SEQ ID NO: 5162 - protein, 10 aa, Artificial Sequence
  Description of Artificial Sequence:  Synthetic Peptide
APHEHGSKDL

SEQ ID NO: 5163 - protein, 10 aa, Artificial Sequence
  Description of Artificial Sequence:  Synthetic Peptide
GSKDLVPGGL

SEQ ID NO: 5164 - protein, 10 aa, Artificial Sequence
  Description of Artificial Sequence:  Synthetic Peptide
SSASTGMKSM

SEQ ID NO: 5165 - protein, 10 aa, Artificial Sequence
  Description of Artificial Sequence:  Synthetic Peptide
MTSAFRVTRY

SEQ ID NO: 5166 - protein, 9 aa, Artificial Sequence
  Description of Artificial Sequence:  Synthetic Peptide
TMAPKRPRV

SEQ ID NO: 5167 - protein, 9 aa, Artificial Sequence
  Description of Artificial Sequence:  Synthetic Peptide
VLSRPVMLT

SEQ ID NO: 5168 - protein, 9 aa, Artificial Sequence
  Description of Artificial Sequence:  Synthetic Peptide
WVTVDRTWI

SEQ ID NO: 5169 - protein, 9 aa, Artificial Sequence
  Description of Artificial Sequence:  Synthetic Peptide
VMLTTMAPK

SEQ ID NO: 5170 - protein, 9 aa, Artificial Sequence
  Description of Artificial Sequence:  Synthetic Peptide
VPRKDWVTV

SEQ ID NO: 5171 - protein, 9 aa, Artificial Sequence
  Description of Artificial Sequence:  Synthetic Peptide
SVLSRPVML

SEQ ID NO: 5172 - protein, 9 aa, Artificial Sequence
  Description of Artificial Sequence:  Synthetic Peptide
APKRPRVCW

SEQ ID NO: 5173 - protein, 9 aa, Artificial Sequence
  Description of Artificial Sequence:  Synthetic Peptide
VPRKDWVTV

SEQ ID NO: 5174 - protein, 9 aa, Artificial Sequence
  Description of Artificial Sequence:  Synthetic Peptide
CSVLSRPVM

SEQ ID NO: 5175 - protein, 10 aa, Artificial Sequence
  Description of Artificial Sequence:  Synthetic Peptide
VLSRPVMLTT

SEQ ID NO: 5176 - protein, 10 aa, Artificial Sequence
  Description of Artificial Sequence:  Synthetic Peptide
LSRPVMLTTM

SEQ ID NO: 5177 - protein, 10 aa, Artificial Sequence
  Description of Artificial Sequence:  Synthetic Peptide
APKRPRVCWA

SEQ ID NO: 5178 - protein, 10 aa, Artificial Sequence
  Description of Artificial Sequence:  Synthetic Peptide
LSRPVMLTTM

SEQ ID NO: 5179 - protein, 9 aa, Artificial Sequence
  Description of Artificial Sequence:  Synthetic Peptide
TMTFFSIGL

SEQ ID NO: 5180 - protein, 9 aa, Artificial Sequence
  Description of Artificial Sequence:  Synthetic Peptide
KMIGSTATA

SEQ ID NO: 5181 - protein, 9 aa, Artificial Sequence
  Description of Artificial Sequence:  Synthetic Peptide
ATAKSRRPL

SEQ ID NO: 5182 - protein, 9 aa, Artificial Sequence
  Description of Artificial Sequence:  Synthetic Peptide
TAKSRRPLA

SEQ ID NO: 5183 - protein, 9 aa, Artificial Sequence
  Description of Artificial Sequence:  Synthetic Peptide
RPLAAQSDI

SEQ ID NO: 5184 - protein, 10 aa, Artificial Sequence
  Description of Artificial Sequence:  Synthetic Peptide
KMIGSTATAK

SEQ ID NO: 5185 - protein, 10 aa, Artificial Sequence
  Description of Artificial Sequence:  Synthetic Peptide
APQTMTFFSI

SEQ ID NO: 5186 - protein, 10 aa, Artificial Sequence
  Description of Artificial Sequence:  Synthetic Peptide
TATAKSRRPL

SEQ ID NO: 5187 - protein, 10 aa, Artificial Sequence
  Description of Artificial Sequence:  Synthetic Peptide
QTMTFFSIGL

SEQ ID NO: 5188 - protein, 10 aa, Artificial Sequence
  Description of Artificial Sequence:  Synthetic Peptide
TAKSRRPLAA

SEQ ID NO: 5189 - protein, 10 aa, Artificial Sequence
  Description of Artificial Sequence:  Synthetic Peptide
MPSRPPRACM

SEQ ID NO: 5190 - protein, 10 aa, Artificial Sequence
  Description of Artificial Sequence:  Synthetic Peptide
MPSRPPRACM

SEQ ID NO: 5191 - protein, 10 aa, Artificial Sequence
  Description of Artificial Sequence:  Synthetic Peptide
MSNTTPGQNM

SEQ ID NO: 5192 - protein, 9 aa, Artificial Sequence
  Description of Artificial Sequence:  Synthetic Peptide
KMTKYRKPL

SEQ ID NO: 5193 - protein, 9 aa, Artificial Sequence
  Description of Artificial Sequence:  Synthetic Peptide
KLHAAVSLC

SEQ ID NO: 5194 - protein, 9 aa, Artificial Sequence
  Description of Artificial Sequence:  Synthetic Peptide
KMAHSVVEC

SEQ ID NO: 5195 - protein, 9 aa, Artificial Sequence
  Description of Artificial Sequence:  Synthetic Peptide
MYQAATKKM

SEQ ID NO: 5196 - protein, 9 aa, Artificial Sequence
  Description of Artificial Sequence:  Synthetic Peptide
KYRKPLQLA

SEQ ID NO: 5197 - protein, 9 aa, Artificial Sequence
  Description of Artificial Sequence:  Synthetic Peptide
QLAALAACK

SEQ ID NO: 5198 - protein, 9 aa, Artificial Sequence
  Description of Artificial Sequence:  Synthetic Peptide
TIFWWRWSR

SEQ ID NO: 5199 - protein, 9 aa, Artificial Sequence
  Description of Artificial Sequence:  Synthetic Peptide
YMYCTSTIF

SEQ ID NO: 5200 - protein, 9 aa, Artificial Sequence
  Description of Artificial Sequence:  Synthetic Peptide
SQRSPRVKL

SEQ ID NO: 5201 - protein, 9 aa, Artificial Sequence
  Description of Artificial Sequence:  Synthetic Peptide
IPPTYILIL

SEQ ID NO: 5202 - protein, 9 aa, Artificial Sequence
  Description of Artificial Sequence:  Synthetic Peptide
CNRGDSWLL

SEQ ID NO: 5203 - protein, 9 aa, Artificial Sequence
  Description of Artificial Sequence:  Synthetic Peptide
SPRVKLHAA

SEQ ID NO: 5204 - protein, 9 aa, Artificial Sequence
  Description of Artificial Sequence:  Synthetic Peptide
SPRVKLHAA

SEQ ID NO: 5205 - protein, 9 aa, Artificial Sequence
  Description of Artificial Sequence:  Synthetic Peptide
SARRRNKST

SEQ ID NO: 5206 - protein, 9 aa, Artificial Sequence
  Description of Artificial Sequence:  Synthetic Peptide
RAGDRPYMY

SEQ ID NO: 5207 - protein, 9 aa, Artificial Sequence
  Description of Artificial Sequence:  Synthetic Peptide
IPPTYILIL

SEQ ID NO: 5208 - protein, 9 aa, Artificial Sequence
  Description of Artificial Sequence:  Synthetic Peptide
AATKKMTKY

SEQ ID NO: 5209 - protein, 9 aa, Artificial Sequence
  Description of Artificial Sequence:  Synthetic Peptide
SEKEQGKMA

SEQ ID NO: 5210 - protein, 9 aa, Artificial Sequence
  Description of Artificial Sequence:  Synthetic Peptide
VECNRGDSW

SEQ ID NO: 5211 - protein, 10 aa, Artificial Sequence
  Description of Artificial Sequence:  Synthetic Peptide
SLCSIPPTYI

SEQ ID NO: 5212 - protein, 10 aa, Artificial Sequence
  Description of Artificial Sequence:  Synthetic Peptide
PYMYCTSTIF

SEQ ID NO: 5213 - protein, 10 aa, Artificial Sequence
  Description of Artificial Sequence:  Synthetic Peptide
KSQRSPRVKL

SEQ ID NO: 5214 - protein, 10 aa, Artificial Sequence
  Description of Artificial Sequence:  Synthetic Peptide
KYRKPLQLAA

SEQ ID NO: 5215 - protein, 10 aa, Artificial Sequence
  Description of Artificial Sequence:  Synthetic Peptide
FVRAGDRPYM

SEQ ID NO: 5216 - protein, 10 aa, Artificial Sequence
  Description of Artificial Sequence:  Synthetic Peptide
SPRVKLHAAV

SEQ ID NO: 5217 - protein, 10 aa, Artificial Sequence
  Description of Artificial Sequence:  Synthetic Peptide
RVKLHAAVSL

SEQ ID NO: 5218 - protein, 10 aa, Artificial Sequence
  Description of Artificial Sequence:  Synthetic Peptide
MTKYRKPLQL

SEQ ID NO: 5219 - protein, 10 aa, Artificial Sequence
  Description of Artificial Sequence:  Synthetic Peptide
SSKSQRSPRV

SEQ ID NO: 5220 - protein, 10 aa, Artificial Sequence
  Description of Artificial Sequence:  Synthetic Peptide
RPYMYCTSTI

SEQ ID NO: 5221 - protein, 10 aa, Artificial Sequence
  Description of Artificial Sequence:  Synthetic Peptide
SPRVKLHAAV

SEQ ID NO: 5222 - protein, 10 aa, Artificial Sequence
  Description of Artificial Sequence:  Synthetic Peptide
VSLCSIPPTY

SEQ ID NO: 5223 - protein, 10 aa, Artificial Sequence
  Description of Artificial Sequence:  Synthetic Peptide
KSQRSPRVKL

SEQ ID NO: 5224 - protein, 10 aa, Artificial Sequence
  Description of Artificial Sequence:  Synthetic Peptide
QAATKKMTKY

SEQ ID NO: 5225 - protein, 9 aa, Artificial Sequence
  Description of Artificial Sequence:  Synthetic Peptide
VLFNRKTSV

SEQ ID NO: 5226 - protein, 9 aa, Artificial Sequence
  Description of Artificial Sequence:  Synthetic Peptide
VLVKPVEFI

SEQ ID NO: 5227 - protein, 9 aa, Artificial Sequence
  Description of Artificial Sequence:  Synthetic Peptide
APQVLVKPV

SEQ ID NO: 5228 - protein, 9 aa, Artificial Sequence
  Description of Artificial Sequence:  Synthetic Peptide
DPRGGRVLF

SEQ ID NO: 5229 - protein, 10 aa, Artificial Sequence
  Description of Artificial Sequence:  Synthetic Peptide
RVLFNRKTSV

SEQ ID NO: 5230 - protein, 10 aa, Artificial Sequence
  Description of Artificial Sequence:  Synthetic Peptide
QVLVKPVEFI

SEQ ID NO: 5231 - protein, 10 aa, Artificial Sequence
  Description of Artificial Sequence:  Synthetic Peptide
KTSVSFSPHV

SEQ ID NO: 5232 - protein, 10 aa, Artificial Sequence
  Description of Artificial Sequence:  Synthetic Peptide
LFNRKTSVSF

SEQ ID NO: 5233 - protein, 10 aa, Artificial Sequence
  Description of Artificial Sequence:  Synthetic Peptide
DPRGGRVLFN

SEQ ID NO: 5234 - protein, 9 aa, Artificial Sequence
  Description of Artificial Sequence:  Synthetic Peptide
VLISWMFCL

SEQ ID NO: 5235 - protein, 9 aa, Artificial Sequence
  Description of Artificial Sequence:  Synthetic Peptide
LVLISWMFC

SEQ ID NO: 5236 - protein, 9 aa, Artificial Sequence
  Description of Artificial Sequence:  Synthetic Peptide
VLISWMFCL

SEQ ID NO: 5237 - protein, 9 aa, Artificial Sequence
  Description of Artificial Sequence:  Synthetic Peptide
LPLVLISWM

SEQ ID NO: 5238 - protein, 9 aa, Artificial Sequence
  Description of Artificial Sequence:  Synthetic Peptide
LPLVLISWM

SEQ ID NO: 5239 - protein, 10 aa, Artificial Sequence
  Description of Artificial Sequence:  Synthetic Peptide
LVLISWMFCL

SEQ ID NO: 5240 - protein, 10 aa, Artificial Sequence
  Description of Artificial Sequence:  Synthetic Peptide
QLPLVLISWM

SEQ ID NO: 5241 - protein, 10 aa, Artificial Sequence
  Description of Artificial Sequence:  Synthetic Peptide
EPGERRPAKL

SEQ ID NO: 5242 - protein, 10 aa, Artificial Sequence
  Description of Artificial Sequence:  Synthetic Peptide
LVLISWMFCL

SEQ ID NO: 5243 - protein, 10 aa, Artificial Sequence
  Description of Artificial Sequence:  Synthetic Peptide
EPGERRPAKL

SEQ ID NO: 5244 - protein, 10 aa, Artificial Sequence
  Description of Artificial Sequence:  Synthetic Peptide
ERRPAKLSVL

SEQ ID NO: 5245 - protein, 10 aa, Artificial Sequence
  Description of Artificial Sequence:  Synthetic Peptide
EPGERRPAKL

SEQ ID NO: 5246 - protein, 10 aa, Artificial Sequence
  Description of Artificial Sequence:  Synthetic Peptide
LPLVLISWMF

SEQ ID NO: 5247 - protein, 10 aa, Artificial Sequence
  Description of Artificial Sequence:  Synthetic Peptide
TLAHAPCIEK

SEQ ID NO: 5248 - protein, 9 aa, Artificial Sequence
  Description of Artificial Sequence:  Synthetic Peptide
SMMTSGTRI

SEQ ID NO: 5249 - protein, 9 aa, Artificial Sequence
  Description of Artificial Sequence:  Synthetic Peptide
VMVPRMEQL

SEQ ID NO: 5250 - protein, 9 aa, Artificial Sequence
  Description of Artificial Sequence:  Synthetic Peptide
IMNIWAASI

SEQ ID NO: 5251 - protein, 9 aa, Artificial Sequence
  Description of Artificial Sequence:  Synthetic Peptide
GEIMNIWAA

SEQ ID NO: 5252 - protein, 10 aa, Artificial Sequence
  Description of Artificial Sequence:  Synthetic Peptide
IMSHAIRCPV

SEQ ID NO: 5253 - protein, 10 aa, Artificial Sequence
  Description of Artificial Sequence:  Synthetic Peptide
QLHSCTNQWC

SEQ ID NO: 5254 - protein, 10 aa, Artificial Sequence
  Description of Artificial Sequence:  Synthetic Peptide
VPRMEQLHSC

SEQ ID NO: 5255 - protein, 10 aa, Artificial Sequence
  Description of Artificial Sequence:  Synthetic Peptide
MSHAIRCPVM

SEQ ID NO: 5256 - protein, 10 aa, Artificial Sequence
  Description of Artificial Sequence:  Synthetic Peptide
GEIMNIWAAS

SEQ ID NO: 5257 - protein, 9 aa, Artificial Sequence
  Description of Artificial Sequence:  Synthetic Peptide
SMCVRKPCV

SEQ ID NO: 5258 - protein, 9 aa, Artificial Sequence
  Description of Artificial Sequence:  Synthetic Peptide
IQHRDVFPT

SEQ ID NO: 5259 - protein, 9 aa, Artificial Sequence
  Description of Artificial Sequence:  Synthetic Peptide
APRCCTATF

SEQ ID NO: 5260 - protein, 9 aa, Artificial Sequence
  Description of Artificial Sequence:  Synthetic Peptide
CVRAPRCCT

SEQ ID NO: 5261 - protein, 9 aa, Artificial Sequence
  Description of Artificial Sequence:  Synthetic Peptide
APRCCTATF

SEQ ID NO: 5262 - protein, 10 aa, Artificial Sequence
  Description of Artificial Sequence:  Synthetic Peptide
GIQHRDVFPT

SEQ ID NO: 5263 - protein, 9 aa, Artificial Sequence
  Description of Artificial Sequence:  Synthetic Peptide
MLSLEQSLV

SEQ ID NO: 5264 - protein, 10 aa, Artificial Sequence
  Description of Artificial Sequence:  Synthetic Peptide
LSLEQSLVTM

SEQ ID NO: 5265 - protein, 9 aa, Artificial Sequence
  Description of Artificial Sequence:  Synthetic Peptide
IEKEQPGRF

SEQ ID NO: 5266 - protein, 9 aa, Artificial Sequence
  Description of Artificial Sequence:  Synthetic Peptide
IEKEQPGRF

SEQ ID NO: 5267 - protein, 9 aa, Artificial Sequence
  Description of Artificial Sequence:  Synthetic Peptide
KEQPGRFPV

SEQ ID NO: 5268 - protein, 9 aa, Artificial Sequence
  Description of Artificial Sequence:  Synthetic Peptide
RSEVFLVVR

SEQ ID NO: 5269 - protein, 9 aa, Artificial Sequence
  Description of Artificial Sequence:  Synthetic Peptide
RLVFLLVFL

SEQ ID NO: 5270 - protein, 9 aa, Artificial Sequence
  Description of Artificial Sequence:  Synthetic Peptide
FLVVRTPNL

SEQ ID NO: 5271 - protein, 9 aa, Artificial Sequence
  Description of Artificial Sequence:  Synthetic Peptide
GYPGFPQDL

SEQ ID NO: 5272 - protein, 9 aa, Artificial Sequence
  Description of Artificial Sequence:  Synthetic Peptide
RLVFLLVFL

SEQ ID NO: 5273 - protein, 9 aa, Artificial Sequence
  Description of Artificial Sequence:  Synthetic Peptide
RSLGMGWRL

SEQ ID NO: 5274 - protein, 9 aa, Artificial Sequence
  Description of Artificial Sequence:  Synthetic Peptide
CGRRLVFLL

SEQ ID NO: 5275 - protein, 9 aa, Artificial Sequence
  Description of Artificial Sequence:  Synthetic Peptide
RVSMTLPTL

SEQ ID NO: 5276 - protein, 9 aa, Artificial Sequence
  Description of Artificial Sequence:  Synthetic Peptide
SCGRRLVFL

SEQ ID NO: 5277 - protein, 9 aa, Artificial Sequence
  Description of Artificial Sequence:  Synthetic Peptide
HPAQPSPSF

SEQ ID NO: 5278 - protein, 9 aa, Artificial Sequence
  Description of Artificial Sequence:  Synthetic Peptide
RSLGMGWRL

SEQ ID NO: 5279 - protein, 9 aa, Artificial Sequence
  Description of Artificial Sequence:  Synthetic Peptide
SEVFLVVRT

SEQ ID NO: 5280 - protein, 10 aa, Artificial Sequence
  Description of Artificial Sequence:  Synthetic Peptide
RGWDRSEVFL

SEQ ID NO: 5281 - protein, 10 aa, Artificial Sequence
  Description of Artificial Sequence:  Synthetic Peptide
NLTSCGRRLV

SEQ ID NO: 5282 - protein, 10 aa, Artificial Sequence
  Description of Artificial Sequence:  Synthetic Peptide
VFLVVRTPNL

SEQ ID NO: 5283 - protein, 10 aa, Artificial Sequence
  Description of Artificial Sequence:  Synthetic Peptide
KPHVRVSMTL

SEQ ID NO: 5284 - protein, 10 aa, Artificial Sequence
  Description of Artificial Sequence:  Synthetic Peptide
PYRGQGYPGF

SEQ ID NO: 5285 - protein, 10 aa, Artificial Sequence
  Description of Artificial Sequence:  Synthetic Peptide
SLGMGWRLPR

SEQ ID NO: 5286 - protein, 10 aa, Artificial Sequence
  Description of Artificial Sequence:  Synthetic Peptide
VVRTPNLGPL

SEQ ID NO: 5287 - protein, 10 aa, Artificial Sequence
  Description of Artificial Sequence:  Synthetic Peptide
KPHVRVSMTL

SEQ ID NO: 5288 - protein, 10 aa, Artificial Sequence
  Description of Artificial Sequence:  Synthetic Peptide
LPRGWDRSEV

SEQ ID NO: 5289 - protein, 10 aa, Artificial Sequence
  Description of Artificial Sequence:  Synthetic Peptide
TLRDLCRGSL

SEQ ID NO: 5290 - protein, 10 aa, Artificial Sequence
  Description of Artificial Sequence:  Synthetic Peptide
LPVERRSLGM

SEQ ID NO: 5291 - protein, 10 aa, Artificial Sequence
  Description of Artificial Sequence:  Synthetic Peptide
EPRGDRSHPA

SEQ ID NO: 5292 - protein, 10 aa, Artificial Sequence
  Description of Artificial Sequence:  Synthetic Peptide
YPMRSAKPHV

SEQ ID NO: 5293 - protein, 10 aa, Artificial Sequence
  Description of Artificial Sequence:  Synthetic Peptide
EPRGDRSHPA

SEQ ID NO: 5294 - protein, 10 aa, Artificial Sequence
  Description of Artificial Sequence:  Synthetic Peptide
TLRDLCRGSL

SEQ ID NO: 5295 - protein, 10 aa, Artificial Sequence
  Description of Artificial Sequence:  Synthetic Peptide
LPVERRSLGM

SEQ ID NO: 5296 - protein, 10 aa, Artificial Sequence
  Description of Artificial Sequence:  Synthetic Peptide
KPHVRVSMTL

SEQ ID NO: 5297 - protein, 10 aa, Artificial Sequence
  Description of Artificial Sequence:  Synthetic Peptide
SAKPHVRVSM

SEQ ID NO: 5298 - protein, 10 aa, Artificial Sequence
  Description of Artificial Sequence:  Synthetic Peptide
LPRGWDRSEV

SEQ ID NO: 5299 - protein, 10 aa, Artificial Sequence
  Description of Artificial Sequence:  Synthetic Peptide
VERRSLGMGW

SEQ ID NO: 5300 - protein, 9 aa, Artificial Sequence
  Description of Artificial Sequence:  Synthetic Peptide
LLSSRRKRL

SEQ ID NO: 5301 - protein, 9 aa, Artificial Sequence
  Description of Artificial Sequence:  Synthetic Peptide
SSRRKRLAM

SEQ ID NO: 5302 - protein, 9 aa, Artificial Sequence
  Description of Artificial Sequence:  Synthetic Peptide
GATLRHESL

SEQ ID NO: 5303 - protein, 9 aa, Artificial Sequence
  Description of Artificial Sequence:  Synthetic Peptide
SSRRKRLAM

SEQ ID NO: 5304 - protein, 9 aa, Artificial Sequence
  Description of Artificial Sequence:  Synthetic Peptide
GATLRHESL

SEQ ID NO: 5305 - protein, 10 aa, Artificial Sequence
  Description of Artificial Sequence:  Synthetic Peptide
ELLSSRRKRL

SEQ ID NO: 5306 - protein, 9 aa, Artificial Sequence
  Description of Artificial Sequence:  Synthetic Peptide
SSRRKRLAM

SEQ ID NO: 5307 - protein, 10 aa, Artificial Sequence
  Description of Artificial Sequence:  Synthetic Peptide
LSSRRKRLAM

SEQ ID NO: 5308 - protein, 9 aa, Artificial Sequence
  Description of Artificial Sequence:  Synthetic Peptide
VVLPISWGT

SEQ ID NO: 5309 - protein, 10 aa, Artificial Sequence
  Description of Artificial Sequence:  Synthetic Peptide
VLPISWGTSL

SEQ ID NO: 5310 - protein, 10 aa, Artificial Sequence
  Description of Artificial Sequence:  Synthetic Peptide
LLGAPATPGI

SEQ ID NO: 5311 - protein, 10 aa, Artificial Sequence
  Description of Artificial Sequence:  Synthetic Peptide
SLSLAPLSEA

SEQ ID NO: 5312 - protein, 9 aa, Artificial Sequence
  Description of Artificial Sequence:  Synthetic Peptide
LPISWGTSL

SEQ ID NO: 5313 - protein, 9 aa, Artificial Sequence
  Description of Artificial Sequence:  Synthetic Peptide
CPLAGLVLL

SEQ ID NO: 5314 - protein, 9 aa, Artificial Sequence
  Description of Artificial Sequence:  Synthetic Peptide
SPELWHTVL

SEQ ID NO: 5315 - protein, 10 aa, Artificial Sequence
  Description of Artificial Sequence:  Synthetic Peptide
APLSEASPEL

SEQ ID NO: 5316 - protein, 10 aa, Artificial Sequence
  Description of Artificial Sequence:  Synthetic Peptide
AVGQVGSCPL

SEQ ID NO: 5317 - protein, 10 aa, Artificial Sequence
  Description of Artificial Sequence:  Synthetic Peptide
QVGSCPLAGL

SEQ ID NO: 5318 - protein, 10 aa, Artificial Sequence
  Description of Artificial Sequence:  Synthetic Peptide
ASPELWHTVL

SEQ ID NO: 5319 - protein, 9 aa, Artificial Sequence
  Description of Artificial Sequence:  Synthetic Peptide
LPISWGTSL

SEQ ID NO: 5320 - protein, 9 aa, Artificial Sequence
  Description of Artificial Sequence:  Synthetic Peptide
CPLAGLVLL

SEQ ID NO: 5321 - protein, 10 aa, Artificial Sequence
  Description of Artificial Sequence:  Synthetic Peptide
APLSEASPEL

SEQ ID NO: 5322 - protein, 10 aa, Artificial Sequence
  Description of Artificial Sequence:  Synthetic Peptide
ASPELWHTVL

SEQ ID NO: 5323 - protein, 10 aa, Artificial Sequence
  Description of Artificial Sequence:  Synthetic Peptide
SEASPELWHT

SEQ ID NO: 5324 - protein, 10 aa, Artificial Sequence
  Description of Artificial Sequence:  Synthetic Peptide
METRVAVGQV

SEQ ID NO: 5325 - protein, 9 aa, Artificial Sequence
  Description of Artificial Sequence:  Synthetic Peptide
ATTPLMIAR

SEQ ID NO: 5326 - protein, 9 aa, Artificial Sequence
  Description of Artificial Sequence:  Synthetic Peptide
SLTQFSIFL

SEQ ID NO: 5327 - protein, 9 aa, Artificial Sequence
  Description of Artificial Sequence:  Synthetic Peptide
FLSSYLLFC

SEQ ID NO: 5328 - protein, 9 aa, Artificial Sequence
  Description of Artificial Sequence:  Synthetic Peptide
ALFLSSYLL

SEQ ID NO: 5329 - protein, 9 aa, Artificial Sequence
  Description of Artificial Sequence:  Synthetic Peptide
GIYPVALFL

SEQ ID NO: 5330 - protein, 9 aa, Artificial Sequence
  Description of Artificial Sequence:  Synthetic Peptide
TQFSIFLDV

SEQ ID NO: 5331 - protein, 9 aa, Artificial Sequence
  Description of Artificial Sequence:  Synthetic Peptide
LLFCRALQC

SEQ ID NO: 5332 - protein, 9 aa, Artificial Sequence
  Description of Artificial Sequence:  Synthetic Peptide
ALATTPLMI

SEQ ID NO: 5333 - protein, 9 aa, Artificial Sequence
  Description of Artificial Sequence:  Synthetic Peptide
VALFLSSYL

SEQ ID NO: 5334 - protein, 10 aa, Artificial Sequence
  Description of Artificial Sequence:  Synthetic Peptide
YLLFCRALQC

SEQ ID NO: 5335 - protein, 10 aa, Artificial Sequence
  Description of Artificial Sequence:  Synthetic Peptide
LQWKSGTSAL

SEQ ID NO: 5336 - protein, 10 aa, Artificial Sequence
  Description of Artificial Sequence:  Synthetic Peptide
SSLTQFSIFL

SEQ ID NO: 5337 - protein, 9 aa, Artificial Sequence
  Description of Artificial Sequence:  Synthetic Peptide
SYLLFCRAL

SEQ ID NO: 5338 - protein, 9 aa, Artificial Sequence
  Description of Artificial Sequence:  Synthetic Peptide
LFLSSYLLF

SEQ ID NO: 5339 - protein, 10 aa, Artificial Sequence
  Description of Artificial Sequence:  Synthetic Peptide
RGIYPVALFL

SEQ ID NO: 5340 - protein, 10 aa, Artificial Sequence
  Description of Artificial Sequence:  Synthetic Peptide
IYPVALFLSS

SEQ ID NO: 5341 - protein, 10 aa, Artificial Sequence
  Description of Artificial Sequence:  Synthetic Peptide
ALQCQCLQWK

SEQ ID NO: 5342 - protein, 10 aa, Artificial Sequence
  Description of Artificial Sequence:  Synthetic Peptide
ALFLSSYLLF

SEQ ID NO: 5343 - protein, 10 aa, Artificial Sequence
  Description of Artificial Sequence:  Synthetic Peptide
FLSSYLLFCR

SEQ ID NO: 5344 - protein, 10 aa, Artificial Sequence
  Description of Artificial Sequence:  Synthetic Peptide
TMVPCAAGYK

SEQ ID NO: 5345 - protein, 9 aa, Artificial Sequence
  Description of Artificial Sequence:  Synthetic Peptide
ALFLSSYLL

SEQ ID NO: 5346 - protein, 9 aa, Artificial Sequence
  Description of Artificial Sequence:  Synthetic Peptide
VALFLSSYL

SEQ ID NO: 5347 - protein, 10 aa, Artificial Sequence
  Description of Artificial Sequence:  Synthetic Peptide
MQRGIYPVAL

SEQ ID NO: 5348 - protein, 10 aa, Artificial Sequence
  Description of Artificial Sequence:  Synthetic Peptide
FCRALQCQCL

SEQ ID NO: 5349 - protein, 10 aa, Artificial Sequence
  Description of Artificial Sequence:  Synthetic Peptide
VALFLSSYLL

SEQ ID NO: 5350 - protein, 10 aa, Artificial Sequence
  Description of Artificial Sequence:  Synthetic Peptide
FCRALQCQCL

SEQ ID NO: 5351 - protein, 9 aa, Artificial Sequence
  Description of Artificial Sequence:  Synthetic Peptide
SPGSSLTQF

SEQ ID NO: 5352 - protein, 10 aa, Artificial Sequence
  Description of Artificial Sequence:  Synthetic Peptide
YPVALFLSSY

SEQ ID NO: 5353 - protein, 10 aa, Artificial Sequence
  Description of Artificial Sequence:  Synthetic Peptide
TSALATTPLM

SEQ ID NO: 5354 - protein, 9 aa, Artificial Sequence
  Description of Artificial Sequence:  Synthetic Peptide
RGIYPVALF

SEQ ID NO: 5355 - protein, 9 aa, Artificial Sequence
  Description of Artificial Sequence:  Synthetic Peptide
ALLASLSLV

SEQ ID NO: 5356 - protein, 9 aa, Artificial Sequence
  Description of Artificial Sequence:  Synthetic Peptide
PARQWAGPL

SEQ ID NO: 5357 - protein, 9 aa, Artificial Sequence
  Description of Artificial Sequence:  Synthetic Peptide
GALLASLSL

SEQ ID NO: 5358 - protein, 9 aa, Artificial Sequence
  Description of Artificial Sequence:  Synthetic Peptide
WAGPLGALL

SEQ ID NO: 5359 - protein, 10 aa, Artificial Sequence
  Description of Artificial Sequence:  Synthetic Peptide
GPLGALLASL

SEQ ID NO: 5360 - protein, 10 aa, Artificial Sequence
  Description of Artificial Sequence:  Synthetic Peptide
RPPIPPARQW

SEQ ID NO: 5361 - protein, 10 aa, Artificial Sequence
  Description of Artificial Sequence:  Synthetic Peptide
GPLGALLASL

SEQ ID NO: 5362 - protein, 9 aa, Artificial Sequence
  Description of Artificial Sequence:  Synthetic Peptide
CLPAVGWMI

SEQ ID NO: 5363 - protein, 9 aa, Artificial Sequence
  Description of Artificial Sequence:  Synthetic Peptide
FMPTNSTAL

SEQ ID NO: 5364 - protein, 9 aa, Artificial Sequence
  Description of Artificial Sequence:  Synthetic Peptide
ALAAPSVCL

SEQ ID NO: 5365 - protein, 10 aa, Artificial Sequence
  Description of Artificial Sequence:  Synthetic Peptide
FVSGGEPWNT

SEQ ID NO: 5366 - protein, 10 aa, Artificial Sequence
  Description of Artificial Sequence:  Synthetic Peptide
FMPTNSTALA

SEQ ID NO: 5367 - protein, 10 aa, Artificial Sequence
  Description of Artificial Sequence:  Synthetic Peptide
CFMPTNSTAL

SEQ ID NO: 5368 - protein, 9 aa, Artificial Sequence
  Description of Artificial Sequence:  Synthetic Peptide
NTRPTSPML

SEQ ID NO: 5369 - protein, 9 aa, Artificial Sequence
  Description of Artificial Sequence:  Synthetic Peptide
ALAAPSVCL

SEQ ID NO: 5370 - protein, 9 aa, Artificial Sequence
  Description of Artificial Sequence:  Synthetic Peptide
APSVCLPAV

SEQ ID NO: 5371 - protein, 10 aa, Artificial Sequence
  Description of Artificial Sequence:  Synthetic Peptide
TALAAPSVCL

SEQ ID NO: 5372 - protein, 9 aa, Artificial Sequence
  Description of Artificial Sequence:  Synthetic Peptide
LPAVGWMIF

SEQ ID NO: 5373 - protein, 10 aa, Artificial Sequence
  Description of Artificial Sequence:  Synthetic Peptide
MGRCGSSSFL

SEQ ID NO: 5374 - protein, 10 aa, Artificial Sequence
  Description of Artificial Sequence:  Synthetic Peptide
HVETSCMASR

SEQ ID NO: 5375 - protein, 10 aa, Artificial Sequence
  Description of Artificial Sequence:  Synthetic Peptide
TTSPPCQLGR

SEQ ID NO: 5376 - protein, 9 aa, Artificial Sequence
  Description of Artificial Sequence:  Synthetic Peptide
GTWRLPWSL

SEQ ID NO: 5377 - protein, 10 aa, Artificial Sequence
  Description of Artificial Sequence:  Synthetic Peptide
QLGRPRVCGT

SEQ ID NO: 5378 - protein, 10 aa, Artificial Sequence
  Description of Artificial Sequence:  Synthetic Peptide
SLSCSAQWRR

SEQ ID NO: 5379 - protein, 10 aa, Artificial Sequence
  Description of Artificial Sequence:  Synthetic Peptide
RPRVCGTWRL

SEQ ID NO: 5380 - protein, 10 aa, Artificial Sequence
  Description of Artificial Sequence:  Synthetic Peptide
RPRVCGTWRL

SEQ ID NO: 5381 - protein, 10 aa, Artificial Sequence
  Description of Artificial Sequence:  Synthetic Peptide
VETSCMASRF

SEQ ID NO: 5382 - protein, 9 aa, Artificial Sequence
  Description of Artificial Sequence:  Synthetic Peptide
GLVTRPWLA

SEQ ID NO: 5383 - protein, 10 aa, Artificial Sequence
  Description of Artificial Sequence:  Synthetic Peptide
GFSGRYITGL

SEQ ID NO: 5384 - protein, 9 aa, Artificial Sequence
  Description of Artificial Sequence:  Synthetic Peptide
HLFRGFSGR

SEQ ID NO: 5385 - protein, 10 aa, Artificial Sequence
  Description of Artificial Sequence:  Synthetic Peptide
HLFRGFSGRY

SEQ ID NO: 5386 - protein, 10 aa, Artificial Sequence
  Description of Artificial Sequence:  Synthetic Peptide
AQRGTSWDGL

SEQ ID NO: 5387 - protein, 9 aa, Artificial Sequence
  Description of Artificial Sequence:  Synthetic Peptide
MSRPGRSRF

SEQ ID NO: 5388 - protein, 9 aa, Artificial Sequence
  Description of Artificial Sequence:  Synthetic Peptide
TPAQRGTSW

SEQ ID NO: 5389 - protein, 9 aa, Artificial Sequence
  Description of Artificial Sequence:  Synthetic Peptide
CPPSHNPSW

SEQ ID NO: 5390 - protein, 9 aa, Artificial Sequence
  Description of Artificial Sequence:  Synthetic Peptide
ALGDTPWAC

SEQ ID NO: 5391 - protein, 9 aa, Artificial Sequence
  Description of Artificial Sequence:  Synthetic Peptide
FLTTARHQL

SEQ ID NO: 5392 - protein, 9 aa, Artificial Sequence
  Description of Artificial Sequence:  Synthetic Peptide
SLDGRPVFL

SEQ ID NO: 5393 - protein, 9 aa, Artificial Sequence
  Description of Artificial Sequence:  Synthetic Peptide
LLTSSRLNL

SEQ ID NO: 5394 - protein, 9 aa, Artificial Sequence
  Description of Artificial Sequence:  Synthetic Peptide
KLTRWATCT

SEQ ID NO: 5395 - protein, 10 aa, Artificial Sequence
  Description of Artificial Sequence:  Synthetic Peptide
NLLTSSRLNL

SEQ ID NO: 5396 - protein, 10 aa, Artificial Sequence
  Description of Artificial Sequence:  Synthetic Peptide
SLDGRPVFLT

SEQ ID NO: 5397 - protein, 10 aa, Artificial Sequence
  Description of Artificial Sequence:  Synthetic Peptide
FLTTARHQLC

SEQ ID NO: 5398 - protein, 10 aa, Artificial Sequence
  Description of Artificial Sequence:  Synthetic Peptide
TSLDGRPVFL

SEQ ID NO: 5399 - protein, 10 aa, Artificial Sequence
  Description of Artificial Sequence:  Synthetic Peptide
VFLTTARHQL

SEQ ID NO: 5400 - protein, 9 aa, Artificial Sequence
  Description of Artificial Sequence:  Synthetic Peptide
APGVWPNLL

SEQ ID NO: 5401 - protein, 9 aa, Artificial Sequence
  Description of Artificial Sequence:  Synthetic Peptide
HPEDPCSAL

SEQ ID NO: 5402 - protein, 9 aa, Artificial Sequence
  Description of Artificial Sequence:  Synthetic Peptide
GVHCCRQGL

SEQ ID NO: 5403 - protein, 9 aa, Artificial Sequence
  Description of Artificial Sequence:  Synthetic Peptide
LPHIPVRGI

SEQ ID NO: 5404 - protein, 9 aa, Artificial Sequence
  Description of Artificial Sequence:  Synthetic Peptide
CAPGVWPNL

SEQ ID NO: 5405 - protein, 9 aa, Artificial Sequence
  Description of Artificial Sequence:  Synthetic Peptide
VAGRAPRSL

SEQ ID NO: 5406 - protein, 10 aa, Artificial Sequence
  Description of Artificial Sequence:  Synthetic Peptide
APRSLPHIPV

SEQ ID NO: 5407 - protein, 10 aa, Artificial Sequence
  Description of Artificial Sequence:  Synthetic Peptide
TARHQLCPKL

SEQ ID NO: 5408 - protein, 10 aa, Artificial Sequence
  Description of Artificial Sequence:  Synthetic Peptide
WPNLLTSSRL

SEQ ID NO: 5409 - protein, 10 aa, Artificial Sequence
  Description of Artificial Sequence:  Synthetic Peptide
SSRLNLSTSL

SEQ ID NO: 5410 - protein, 10 aa, Artificial Sequence
  Description of Artificial Sequence:  Synthetic Peptide
QVAGRAPRSL

SEQ ID NO: 5411 - protein, 10 aa, Artificial Sequence
  Description of Artificial Sequence:  Synthetic Peptide
CAPGVWPNLL

SEQ ID NO: 5412 - protein, 10 aa, Artificial Sequence
  Description of Artificial Sequence:  Synthetic Peptide
TARHQLCPKL

SEQ ID NO: 5413 - protein, 10 aa, Artificial Sequence
  Description of Artificial Sequence:  Synthetic Peptide
CPKLTRWATC

SEQ ID NO: 5414 - protein, 9 aa, Artificial Sequence
  Description of Artificial Sequence:  Synthetic Peptide
APGVWPNLL

SEQ ID NO: 5415 - protein, 9 aa, Artificial Sequence
  Description of Artificial Sequence:  Synthetic Peptide
HPEDPCSAL

SEQ ID NO: 5416 - protein, 9 aa, Artificial Sequence
  Description of Artificial Sequence:  Synthetic Peptide
TSLDGRPVF

SEQ ID NO: 5417 - protein, 10 aa, Artificial Sequence
  Description of Artificial Sequence:  Synthetic Peptide
WPNLLTSSRL

SEQ ID NO: 5418 - protein, 10 aa, Artificial Sequence
  Description of Artificial Sequence:  Synthetic Peptide
SSRLNLSTSL

SEQ ID NO: 5419 - protein, 10 aa, Artificial Sequence
  Description of Artificial Sequence:  Synthetic Peptide
APRSLPHIPV

SEQ ID NO: 5420 - protein, 10 aa, Artificial Sequence
  Description of Artificial Sequence:  Synthetic Peptide
TSLDGRPVFL

SEQ ID NO: 5421 - protein, 9 aa, Artificial Sequence
  Description of Artificial Sequence:  Synthetic Peptide
SERPCAPGV

SEQ ID NO: 5422 - protein, 10 aa, Artificial Sequence
  Description of Artificial Sequence:  Synthetic Peptide
SERPCAPGVW

SEQ ID NO: 5423 - protein, 10 aa, Artificial Sequence
  Description of Artificial Sequence:  Synthetic Peptide
ASEQSLTRLR

SEQ ID NO: 5424 - protein, 9 aa, Artificial Sequence
  Description of Artificial Sequence:  Synthetic Peptide
SLTRLRPQV

SEQ ID NO: 5425 - protein, 9 aa, Artificial Sequence
  Description of Artificial Sequence:  Synthetic Peptide
IQWTLPPSL

SEQ ID NO: 5426 - protein, 9 aa, Artificial Sequence
  Description of Artificial Sequence:  Synthetic Peptide
LTRLRPQVL

SEQ ID NO: 5427 - protein, 9 aa, Artificial Sequence
  Description of Artificial Sequence:  Synthetic Peptide
APMISSSAT

SEQ ID NO: 5428 - protein, 9 aa, Artificial Sequence
  Description of Artificial Sequence:  Synthetic Peptide
ATSAIQWTL

SEQ ID NO: 5429 - protein, 11 aa, Artificial Sequence
  Description of Artificial Sequence:  Synthetic Peptide
SATSAAIQWTL

SEQ ID NO: 5430 - protein, 10 aa, Artificial Sequence
  Description of Artificial Sequence:  Synthetic Peptide
AIQWTLPPSL

SEQ ID NO: 5431 - protein, 10 aa, Artificial Sequence
  Description of Artificial Sequence:  Synthetic Peptide
LASEQSLTRL

SEQ ID NO: 5432 - protein, 9 aa, Artificial Sequence
  Description of Artificial Sequence:  Synthetic Peptide
LTRLRPQVL

SEQ ID NO: 5433 - protein, 9 aa, Artificial Sequence
  Description of Artificial Sequence:  Synthetic Peptide
RPQVLGWWF

SEQ ID NO: 5434 - protein, 10 aa, Artificial Sequence
  Description of Artificial Sequence:  Synthetic Peptide
MEAAQPAPMI

SEQ ID NO: 5435 - protein, 9 aa, Artificial Sequence
  Description of Artificial Sequence:  Synthetic Peptide
SLFMARLSL

SEQ ID NO: 5436 - protein, 10 aa, Artificial Sequence
  Description of Artificial Sequence:  Synthetic Peptide
RSLFMARLSL

SEQ ID NO: 5437 - protein, 10 aa, Artificial Sequence
  Description of Artificial Sequence:  Synthetic Peptide
RARSLFMARL

SEQ ID NO: 5438 - protein, 10 aa, Artificial Sequence
  Description of Artificial Sequence:  Synthetic Peptide
RARSLFMARL

SEQ ID NO: 5439 - protein, 10 aa, Artificial Sequence
  Description of Artificial Sequence:  Synthetic Peptide
RSLFMARLSL

SEQ ID NO: 5440 - protein, 9 aa, Artificial Sequence
  Description of Artificial Sequence:  Synthetic Peptide
SMPSPTTGV

SEQ ID NO: 5441 - protein, 9 aa, Artificial Sequence
  Description of Artificial Sequence:  Synthetic Peptide
SQQPFGAWA

SEQ ID NO: 5442 - protein, 9 aa, Artificial Sequence
  Description of Artificial Sequence:  Synthetic Peptide
QPFGAWASM

SEQ ID NO: 5443 - protein, 10 aa, Artificial Sequence
  Description of Artificial Sequence:  Synthetic Peptide
GVSTSPLYQL

SEQ ID NO: 5444 - protein, 9 aa, Artificial Sequence
  Description of Artificial Sequence:  Synthetic Peptide
QPFGAWASM

SEQ ID NO: 5445 - protein, 10 aa, Artificial Sequence
  Description of Artificial Sequence:  Synthetic Peptide
MMPGQLGTSL

SEQ ID NO: 5446 - protein, 9 aa, Artificial Sequence
  Description of Artificial Sequence:  Synthetic Peptide
MPGQLGTSL

SEQ ID NO: 5447 - protein, 9 aa, Artificial Sequence
  Description of Artificial Sequence:  Synthetic Peptide
MPGQLGTSL

SEQ ID NO: 5448 - protein, 10 aa, Artificial Sequence
  Description of Artificial Sequence:  Synthetic Peptide
SPRRSKEEIT

SEQ ID NO: 5449 - protein, 10 aa, Artificial Sequence
  Description of Artificial Sequence:  Synthetic Peptide
SPRRSKEEIT

SEQ ID NO: 5450 - protein, 9 aa, Artificial Sequence
  Description of Artificial Sequence:  Synthetic Peptide
SPRRSKEEI

SEQ ID NO: 5451 - protein, 10 aa, Artificial Sequence
  Description of Artificial Sequence:  Synthetic Peptide
RSKEEITLRI

SEQ ID NO: 5452 - protein, 9 aa, Artificial Sequence
  Description of Artificial Sequence:  Synthetic Peptide
SPRRSKEEI

SEQ ID NO: 5453 - protein, 10 aa, Artificial Sequence
  Description of Artificial Sequence:  Synthetic Peptide
LMRWKNAPPK

SEQ ID NO: 5454 - protein, 10 aa, Artificial Sequence
  Description of Artificial Sequence:  Synthetic Peptide
WLWPLTRKSY

SEQ ID NO: 5455 - protein, 10 aa, Artificial Sequence
  Description of Artificial Sequence:  Synthetic Peptide
SLRKGSGWRR

SEQ ID NO: 5456 - protein, 9 aa, Artificial Sequence
  Description of Artificial Sequence:  Synthetic Peptide
WPLTRKSYM

SEQ ID NO: 5457 - protein, 9 aa, Artificial Sequence
  Description of Artificial Sequence:  Synthetic Peptide
NAPPKPPSL

SEQ ID NO: 5458 - protein, 10 aa, Artificial Sequence
  Description of Artificial Sequence:  Synthetic Peptide
LTRKSYMRPL

SEQ ID NO: 5459 - protein, 9 aa, Artificial Sequence
  Description of Artificial Sequence:  Synthetic Peptide
NAPPKPPSL

SEQ ID NO: 5460 - protein, 9 aa, Artificial Sequence
  Description of Artificial Sequence:  Synthetic Peptide
WPLTRKSYM

SEQ ID NO: 5461 - protein, 9 aa, Artificial Sequence
  Description of Artificial Sequence:  Synthetic Peptide
LLTTWRSLT

SEQ ID NO: 5462 - protein, 10 aa, Artificial Sequence
  Description of Artificial Sequence:  Synthetic Peptide
LPLLTTWRSL

SEQ ID NO: 5463 - protein, 10 aa, Artificial Sequence
  Description of Artificial Sequence:  Synthetic Peptide
LPLLTTWRSL

SEQ ID NO: 5464 - protein, 10 aa, Artificial Sequence
  Description of Artificial Sequence:  Synthetic Peptide
WMPTFSWEAM

SEQ ID NO: 5465 - protein, 9 aa, Artificial Sequence
  Description of Artificial Sequence:  Synthetic Peptide
WMPTFSWEA

SEQ ID NO: 5466 - protein, 9 aa, Artificial Sequence
  Description of Artificial Sequence:  Synthetic Peptide
MPTFSWEAM

SEQ ID NO: 5467 - protein, 9 aa, Artificial Sequence
  Description of Artificial Sequence:  Synthetic Peptide
MPTFSWEAM

SEQ ID NO: 5468 - protein, 9 aa, Artificial Sequence
  Description of Artificial Sequence:  Synthetic Peptide
QRDPLPLPR

SEQ ID NO: 5469 - protein, 9 aa, Artificial Sequence
  Description of Artificial Sequence:  Synthetic Peptide
GLQSPIKRI

SEQ ID NO: 5470 - protein, 9 aa, Artificial Sequence
  Description of Artificial Sequence:  Synthetic Peptide
LLSAAPCHT

SEQ ID NO: 5471 - protein, 9 aa, Artificial Sequence
  Description of Artificial Sequence:  Synthetic Peptide
RWQTKCSAL

SEQ ID NO: 5472 - protein, 10 aa, Artificial Sequence
  Description of Artificial Sequence:  Synthetic Peptide
KTPMTPVTPL

SEQ ID NO: 5473 - protein, 9 aa, Artificial Sequence
  Description of Artificial Sequence:  Synthetic Peptide
TPMTPVTPL

SEQ ID NO: 5474 - protein, 9 aa, Artificial Sequence
  Description of Artificial Sequence:  Synthetic Peptide
SVRSSTRTL

SEQ ID NO: 5475 - protein, 9 aa, Artificial Sequence
  Description of Artificial Sequence:  Synthetic Peptide
STRTLSRGL

SEQ ID NO: 5476 - protein, 9 aa, Artificial Sequence
  Description of Artificial Sequence:  Synthetic Peptide
ASSSPLARL

SEQ ID NO: 5477 - protein, 9 aa, Artificial Sequence
  Description of Artificial Sequence:  Synthetic Peptide
TPVTPLGRI

SEQ ID NO: 5478 - protein, 10 aa, Artificial Sequence
  Description of Artificial Sequence:  Synthetic Peptide
LPLRGSRGTL

SEQ ID NO: 5479 - protein, 10 aa, Artificial Sequence
  Description of Artificial Sequence:  Synthetic Peptide
QMRDHCPPCL

SEQ ID NO: 5480 - protein, 10 aa, Artificial Sequence
  Description of Artificial Sequence:  Synthetic Peptide
GSRGTLTWSL

SEQ ID NO: 5481 - protein, 10 aa, Artificial Sequence
  Description of Artificial Sequence:  Synthetic Peptide
LPRGSVRSST

SEQ ID NO: 5482 - protein, 10 aa, Artificial Sequence
  Description of Artificial Sequence:  Synthetic Peptide
SPLARLPLQM

SEQ ID NO: 5483 - protein, 10 aa, Artificial Sequence
  Description of Artificial Sequence:  Synthetic Peptide
TASSSPLARL

SEQ ID NO: 5484 - protein, 9 aa, Artificial Sequence
  Description of Artificial Sequence:  Synthetic Peptide
TPMTPVTPL

SEQ ID NO: 5485 - protein, 9 aa, Artificial Sequence
  Description of Artificial Sequence:  Synthetic Peptide
CSALSKTPM

SEQ ID NO: 5486 - protein, 10 aa, Artificial Sequence
  Description of Artificial Sequence:  Synthetic Peptide
SPLARLPLQM

SEQ ID NO: 5487 - protein, 10 aa, Artificial Sequence
  Description of Artificial Sequence:  Synthetic Peptide
LPLRGSRGTL

SEQ ID NO: 5488 - protein, 10 aa, Artificial Sequence
  Description of Artificial Sequence:  Synthetic Peptide
GSRGTLTWSL

SEQ ID NO: 5489 - protein, 9 aa, Artificial Sequence
  Description of Artificial Sequence:  Synthetic Peptide
TLSGLPLRL

SEQ ID NO: 5490 - protein, 10 aa, Artificial Sequence
  Description of Artificial Sequence:  Synthetic Peptide
TLSGLPLRLV

SEQ ID NO: 5491 - protein, 10 aa, Artificial Sequence
  Description of Artificial Sequence:  Synthetic Peptide
RTLSGLPLRL

SEQ ID NO: 5492 - protein, 10 aa, Artificial Sequence
  Description of Artificial Sequence:  Synthetic Peptide
SCRTLSGLPL

SEQ ID NO: 5493 - protein, 10 aa, Artificial Sequence
  Description of Artificial Sequence:  Synthetic Peptide
SCRTLSGLPL

SEQ ID NO: 5494 - protein, 9 aa, Artificial Sequence
  Description of Artificial Sequence:  Synthetic Peptide
AEKSQLASS

SEQ ID NO: 5495 - protein, 10 aa, Artificial Sequence
  Description of Artificial Sequence:  Synthetic Peptide
AEKSQLASSY

SEQ ID NO: 5496 - protein, 10 aa, Artificial Sequence
  Description of Artificial Sequence:  Synthetic Peptide
SIFSSKLGEV

SEQ ID NO: 5497 - protein, 9 aa, Artificial Sequence
  Description of Artificial Sequence:  Synthetic Peptide
RLSGNLERL

SEQ ID NO: 5498 - protein, 9 aa, Artificial Sequence
  Description of Artificial Sequence:  Synthetic Peptide
TPSHCTHTL

SEQ ID NO: 5499 - protein, 9 aa, Artificial Sequence
  Description of Artificial Sequence:  Synthetic Peptide
TPSHCTHTL

SEQ ID NO: 5500 - protein, 9 aa, Artificial Sequence
  Description of Artificial Sequence:  Synthetic Peptide
LERGRVGRV

SEQ ID NO: 5501 - protein, 9 aa, Artificial Sequence
  Description of Artificial Sequence:  Synthetic Peptide
MPDPAYYSF

SEQ ID NO: 5502 - protein, 9 aa, Artificial Sequence
  Description of Artificial Sequence:  Synthetic Peptide
YYSFAYSYL

SEQ ID NO: 5503 - protein, 10 aa, Artificial Sequence
  Description of Artificial Sequence:  Synthetic Peptide
AYYSFAYSYL

SEQ ID NO: 5504 - protein, 9 aa, Artificial Sequence
  Description of Artificial Sequence:  Synthetic Peptide
DPAYYSFAY

SEQ ID NO: 5505 - protein, 9 aa, Artificial Sequence
  Description of Artificial Sequence:  Synthetic Peptide
DPAYYSFAY

SEQ ID NO: 5506 - protein, 9 aa, Artificial Sequence
  Description of Artificial Sequence:  Synthetic Peptide
DAELVTNSY

SEQ ID NO: 5507 - protein, 9 aa, Artificial Sequence
  Description of Artificial Sequence:  Synthetic Peptide
GLFLHAGSV

SEQ ID NO: 5508 - protein, 10 aa, Artificial Sequence
  Description of Artificial Sequence:  Synthetic Peptide
GIWLGLFLHA

SEQ ID NO: 5509 - protein, 9 aa, Artificial Sequence
  Description of Artificial Sequence:  Synthetic Peptide
RPLGCGIWL

SEQ ID NO: 5510 - protein, 9 aa, Artificial Sequence
  Description of Artificial Sequence:  Synthetic Peptide
RPLGCGIWL

SEQ ID NO: 5511 - protein, 10 aa, Artificial Sequence
  Description of Artificial Sequence:  Synthetic Peptide
GPGNCLRRPL

SEQ ID NO: 5512 - protein, 10 aa, Artificial Sequence
  Description of Artificial Sequence:  Synthetic Peptide
CSRVGPGNCL

SEQ ID NO: 5513 - protein, 9 aa, Artificial Sequence
  Description of Artificial Sequence:  Synthetic Peptide
DPRLRCSCS

SEQ ID NO: 5514 - protein, 9 aa, Artificial Sequence
  Description of Artificial Sequence:  Synthetic Peptide
RPLGCGIWL

SEQ ID NO: 5515 - protein, 10 aa, Artificial Sequence
  Description of Artificial Sequence:  Synthetic Peptide
GPGNCLRRPL

SEQ ID NO: 5516 - protein, 10 aa, Artificial Sequence
  Description of Artificial Sequence:  Synthetic Peptide
CSRVGPGNCL

SEQ ID NO: 5517 - protein, 9 aa, Artificial Sequence
  Description of Artificial Sequence:  Synthetic Peptide
DAELVTNSY

SEQ ID NO: 5518 - protein, 10 aa, Artificial Sequence
  Description of Artificial Sequence:  Synthetic Peptide
HDAELVTNSY

SEQ ID NO: 5519 - protein, 9 aa, Artificial Sequence
  Description of Artificial Sequence:  Synthetic Peptide
RYRPSSVGL

SEQ ID NO: 5520 - protein, 9 aa, Artificial Sequence
  Description of Artificial Sequence:  Synthetic Peptide
GLRAGLLLY

SEQ ID NO: 5521 - protein, 9 aa, Artificial Sequence
  Description of Artificial Sequence:  Synthetic Peptide
SVGLRAGLL

SEQ ID NO: 5522 - protein, 10 aa, Artificial Sequence
  Description of Artificial Sequence:  Synthetic Peptide
SVGLRAGLLL

SEQ ID NO: 5523 - protein, 9 aa, Artificial Sequence
  Description of Artificial Sequence:  Synthetic Peptide
GMGGPPFPV

SEQ ID NO: 5524 - protein, 9 aa, Artificial Sequence
  Description of Artificial Sequence:  Synthetic Peptide
MLLLRPTGT

SEQ ID NO: 5525 - protein, 10 aa, Artificial Sequence
  Description of Artificial Sequence:  Synthetic Peptide
VGMGGPPFPV

SEQ ID NO: 5526 - protein, 10 aa, Artificial Sequence
  Description of Artificial Sequence:  Synthetic Peptide
CYEIHRKVGM

SEQ ID NO: 5527 - protein, 9 aa, Artificial Sequence
  Description of Artificial Sequence:  Synthetic Peptide
AGRRQDLCM

SEQ ID NO: 5528 - protein, 10 aa, Artificial Sequence
  Description of Artificial Sequence:  Synthetic Peptide
FPVAGRRQDL

SEQ ID NO: 5529 - protein, 9 aa, Artificial Sequence
  Description of Artificial Sequence:  Synthetic Peptide
SPKHRGRAV

SEQ ID NO: 5530 - protein, 10 aa, Artificial Sequence
  Description of Artificial Sequence:  Synthetic Peptide
VPLWTFSSCY

SEQ ID NO: 5531 - protein, 9 aa, Artificial Sequence
  Description of Artificial Sequence:  Synthetic Peptide
YEIHRKVGM

SEQ ID NO: 5532 - protein, 9 aa, Artificial Sequence
  Description of Artificial Sequence:  Synthetic Peptide
LLPGDRLHL

SEQ ID NO: 5533 - protein, 10 aa, Artificial Sequence
  Description of Artificial Sequence:  Synthetic Peptide
SLLPGDRLHL

SEQ ID NO: 5534 - protein, 10 aa, Artificial Sequence
  Description of Artificial Sequence:  Synthetic Peptide
RLHLHHWPHT

SEQ ID NO: 5535 - protein, 9 aa, Artificial Sequence
  Description of Artificial Sequence:  Synthetic Peptide
GASRRGSLL

SEQ ID NO: 5536 - protein, 9 aa, Artificial Sequence
  Description of Artificial Sequence:  Synthetic Peptide
GASRRGSLL

SEQ ID NO: 5537 - protein, 9 aa, Artificial Sequence
  Description of Artificial Sequence:  Synthetic Peptide
ILGQTHVEL

SEQ ID NO: 5538 - protein, 9 aa, Artificial Sequence
  Description of Artificial Sequence:  Synthetic Peptide
VELHQWHTV

SEQ ID NO: 5539 - protein, 10 aa, Artificial Sequence
  Description of Artificial Sequence:  Synthetic Peptide
TILGQTHVEL

SEQ ID NO: 5540 - protein, 9 aa, Artificial Sequence
  Description of Artificial Sequence:  Synthetic Peptide
TVPGGTLHL

SEQ ID NO: 5541 - protein, 10 aa, Artificial Sequence
  Description of Artificial Sequence:  Synthetic Peptide
KSRSGINDGF

SEQ ID NO: 5542 - protein, 9 aa, Artificial Sequence
  Description of Artificial Sequence:  Synthetic Peptide
QLLHRRALC

SEQ ID NO: 5543 - protein, 10 aa, Artificial Sequence
  Description of Artificial Sequence:  Synthetic Peptide
QLLHRRALCA

SEQ ID NO: 5544 - protein, 9 aa, Artificial Sequence
  Description of Artificial Sequence:  Synthetic Peptide
NLPHQLLHR

SEQ ID NO: 5545 - protein, 10 aa, Artificial Sequence
  Description of Artificial Sequence:  Synthetic Peptide
LLHRRALCAK

SEQ ID NO: 5546 - protein, 9 aa, Artificial Sequence
  Description of Artificial Sequence:  Synthetic Peptide
LPKHVAGNL

SEQ ID NO: 5547 - protein, 9 aa, Artificial Sequence
  Description of Artificial Sequence:  Synthetic Peptide
AGNLPHQLL

SEQ ID NO: 5548 - protein, 9 aa, Artificial Sequence
  Description of Artificial Sequence:  Synthetic Peptide
VAGNLPHQL

SEQ ID NO: 5549 - protein, 10 aa, Artificial Sequence
  Description of Artificial Sequence:  Synthetic Peptide
HVAGNLPHQL

SEQ ID NO: 5550 - protein, 10 aa, Artificial Sequence
  Description of Artificial Sequence:  Synthetic Peptide
VAGNLPHQLL

SEQ ID NO: 5551 - protein, 9 aa, Artificial Sequence
  Description of Artificial Sequence:  Synthetic Peptide
LPKHVAGNL

SEQ ID NO: 5552 - protein, 9 aa, Artificial Sequence
  Description of Artificial Sequence:  Synthetic Peptide
LPKHVAGNL

SEQ ID NO: 5553 - protein, 10 aa, Artificial Sequence
  Description of Artificial Sequence:  Synthetic Peptide
RSKHLGPRPL

SEQ ID NO: 5554 - protein, 9 aa, Artificial Sequence
  Description of Artificial Sequence:  Synthetic Peptide
QLLHRRALC

SEQ ID NO: 5555 - protein, 10 aa, Artificial Sequence
  Description of Artificial Sequence:  Synthetic Peptide
QLLHRRALCA

SEQ ID NO: 5556 - protein, 9 aa, Artificial Sequence
  Description of Artificial Sequence:  Synthetic Peptide
NLPHQLLHR

SEQ ID NO: 5557 - protein, 10 aa, Artificial Sequence
  Description of Artificial Sequence:  Synthetic Peptide
LLHRRALCAK

SEQ ID NO: 5558 - protein, 9 aa, Artificial Sequence
  Description of Artificial Sequence:  Synthetic Peptide
LPKHVAGNL

SEQ ID NO: 5559 - protein, 9 aa, Artificial Sequence
  Description of Artificial Sequence:  Synthetic Peptide
AGNLPHQLL

SEQ ID NO: 5560 - protein, 9 aa, Artificial Sequence
  Description of Artificial Sequence:  Synthetic Peptide
VAGNLPHQL

SEQ ID NO: 5561 - protein, 10 aa, Artificial Sequence
  Description of Artificial Sequence:  Synthetic Peptide
HVAGNLPHQL

SEQ ID NO: 5562 - protein, 10 aa, Artificial Sequence
  Description of Artificial Sequence:  Synthetic Peptide
VAGNLPHQLL

SEQ ID NO: 5563 - protein, 9 aa, Artificial Sequence
  Description of Artificial Sequence:  Synthetic Peptide
LPKHVAGNL

SEQ ID NO: 5564 - protein, 9 aa, Artificial Sequence
  Description of Artificial Sequence:  Synthetic Peptide
LPKHVAGNL

SEQ ID NO: 5565 - protein, 10 aa, Artificial Sequence
  Description of Artificial Sequence:  Synthetic Peptide
RSKHLGPRPL

SEQ ID NO: 5566 - protein, 10 aa, Artificial Sequence
  Description of Artificial Sequence:  Synthetic Peptide
SVVQPPGPPL

SEQ ID NO: 5567 - protein, 9 aa, Artificial Sequence
  Description of Artificial Sequence:  Synthetic Peptide
VVQPPGPPL

SEQ ID NO: 5568 - protein, 9 aa, Artificial Sequence
  Description of Artificial Sequence:  Synthetic Peptide
RLTDLSQLA

SEQ ID NO: 5569 - protein, 10 aa, Artificial Sequence
  Description of Artificial Sequence:  Synthetic Peptide
KMEPPRKEEK

SEQ ID NO: 5570 - protein, 10 aa, Artificial Sequence
  Description of Artificial Sequence:  Synthetic Peptide
RLTDLSQLAV

SEQ ID NO: 5571 - protein, 10 aa, Artificial Sequence
  Description of Artificial Sequence:  Synthetic Peptide
KMEPPRKEEK

SEQ ID NO: 5572 - protein, 9 aa, Artificial Sequence
  Description of Artificial Sequence:  Synthetic Peptide
FQLWPAGLV

SEQ ID NO: 5573 - protein, 9 aa, Artificial Sequence
  Description of Artificial Sequence:  Synthetic Peptide
RQAHVAFQL

SEQ ID NO: 5574 - protein, 9 aa, Artificial Sequence
  Description of Artificial Sequence:  Synthetic Peptide
AFQLWPAGL

SEQ ID NO: 5575 - protein, 9 aa, Artificial Sequence
  Description of Artificial Sequence:  Synthetic Peptide
RQAHVAFQL

SEQ ID NO: 5576 - protein, 9 aa, Artificial Sequence
  Description of Artificial Sequence:  Synthetic Peptide
AMRRRQAHV

SEQ ID NO: 5577 - protein, 9 aa, Artificial Sequence
  Description of Artificial Sequence:  Synthetic Peptide
TFSSWSSTL

SEQ ID NO: 5578 - protein, 9 aa, Artificial Sequence
  Description of Artificial Sequence:  Synthetic Peptide
RTQFGSHRL

SEQ ID NO: 5579 - protein, 9 aa, Artificial Sequence
  Description of Artificial Sequence:  Synthetic Peptide
FSSWSSTLM

SEQ ID NO: 5580 - protein, 9 aa, Artificial Sequence
  Description of Artificial Sequence:  Synthetic Peptide
RSPWSRTQF

SEQ ID NO: 5581 - protein, 9 aa, Artificial Sequence
  Description of Artificial Sequence:  Synthetic Peptide
VPVGTFSSW

SEQ ID NO: 5582 - protein, 9 aa, Artificial Sequence
  Description of Artificial Sequence:  Synthetic Peptide
REVVPVGTF

SEQ ID NO: 5583 - protein, 10 aa, Artificial Sequence
  Description of Artificial Sequence:  Synthetic Peptide
MSRSQEGCSL

SEQ ID NO: 5584 - protein, 10 aa, Artificial Sequence
  Description of Artificial Sequence:  Synthetic Peptide
GPREVVPVGT

SEQ ID NO: 5585 - protein, 10 aa, Artificial Sequence
  Description of Artificial Sequence:  Synthetic Peptide
MVQKAHDHPL

SEQ ID NO: 5586 - protein, 10 aa, Artificial Sequence
  Description of Artificial Sequence:  Synthetic Peptide
MSRSQEGCSL

SEQ ID NO: 5587 - protein, 10 aa, Artificial Sequence
  Description of Artificial Sequence:  Synthetic Peptide
GPREVVPVGT

SEQ ID NO: 5588 - protein, 10 aa, Artificial Sequence
  Description of Artificial Sequence:  Synthetic Peptide
REVVPVGTFS

SEQ ID NO: 5589 - protein, 10 aa, Artificial Sequence
  Description of Artificial Sequence:  Synthetic Peptide
MPLRDFPVRW

SEQ ID NO: 5590 - protein, 9 aa, Artificial Sequence
  Description of Artificial Sequence:  Synthetic Peptide
VLWPVVGGL

SEQ ID NO: 5591 - protein, 9 aa, Artificial Sequence
  Description of Artificial Sequence:  Synthetic Peptide
WLAVCPGPV

SEQ ID NO: 5592 - protein, 9 aa, Artificial Sequence
  Description of Artificial Sequence:  Synthetic Peptide
LAVCPGPVL

SEQ ID NO: 5593 - protein, 10 aa, Artificial Sequence
  Description of Artificial Sequence:  Synthetic Peptide
VLWPVVGGLV

SEQ ID NO: 5594 - protein, 10 aa, Artificial Sequence
  Description of Artificial Sequence:  Synthetic Peptide
WLAVCPGPVL

SEQ ID NO: 5595 - protein, 10 aa, Artificial Sequence
  Description of Artificial Sequence:  Synthetic Peptide
VCPGPVLWPV

SEQ ID NO: 5596 - protein, 9 aa, Artificial Sequence
  Description of Artificial Sequence:  Synthetic Peptide
APSQFSLYV

SEQ ID NO: 5597 - protein, 10 aa, Artificial Sequence
  Description of Artificial Sequence:  Synthetic Peptide
IAPSQFSLYV

SEQ ID NO: 5598 - protein, 10 aa, Artificial Sequence
  Description of Artificial Sequence:  Synthetic Peptide
CPIAPSQFSL

SEQ ID NO: 5599 - protein, 10 aa, Artificial Sequence
  Description of Artificial Sequence:  Synthetic Peptide
CPIAPSQFSL

SEQ ID NO: 5600 - protein, 9 aa, Artificial Sequence
  Description of Artificial Sequence:  Synthetic Peptide
RYLSVRAGS

SEQ ID NO: 5601 - protein, 9 aa, Artificial Sequence
  Description of Artificial Sequence:  Synthetic Peptide
QLVACCCQK

SEQ ID NO: 5602 - protein, 9 aa, Artificial Sequence
  Description of Artificial Sequence:  Synthetic Peptide
GPWCSSRYL

SEQ ID NO: 5603 - protein, 9 aa, Artificial Sequence
  Description of Artificial Sequence:  Synthetic Peptide
GPWCSSRYL

SEQ ID NO: 5604 - protein, 10 aa, Artificial Sequence
  Description of Artificial Sequence:  Synthetic Peptide
SPPGKFGAQL

SEQ ID NO: 5605 - protein, 10 aa, Artificial Sequence
  Description of Artificial Sequence:  Synthetic Peptide
SPPGKFGAQL

SEQ ID NO: 5606 - protein, 9 aa, Artificial Sequence
  Description of Artificial Sequence:  Synthetic Peptide
WPRGPLCPL

SEQ ID NO: 5607 - protein, 9 aa, Artificial Sequence
  Description of Artificial Sequence:  Synthetic Peptide
WPRGPLCPL

SEQ ID NO: 5608 - protein, 9 aa, Artificial Sequence
  Description of Artificial Sequence:  Synthetic Peptide
WPRGPLCPL

SEQ ID NO: 5609 - protein, 9 aa, Artificial Sequence
  Description of Artificial Sequence:  Synthetic Peptide
PYLPICSGL

SEQ ID NO: 5610 - protein, 9 aa, Artificial Sequence
  Description of Artificial Sequence:  Synthetic Peptide
AAVDSADPY

SEQ ID NO: 5611 - protein, 9 aa, Artificial Sequence
  Description of Artificial Sequence:  Synthetic Peptide
DSADPYPYL

SEQ ID NO: 5612 - protein, 9 aa, Artificial Sequence
  Description of Artificial Sequence:  Synthetic Peptide
AAVDSADPY

SEQ ID NO: 5613 - protein, 9 aa, Artificial Sequence
  Description of Artificial Sequence:  Synthetic Peptide
VDSADPYPY

SEQ ID NO: 5614 - protein, 10 aa, Artificial Sequence
  Description of Artificial Sequence:  Synthetic Peptide
AVDSADPYPY

SEQ ID NO: 5615 - protein, 10 aa, Artificial Sequence
  Description of Artificial Sequence:  Synthetic Peptide
SADPYPYLPI

SEQ ID NO: 5616 - protein, 10 aa, Artificial Sequence
  Description of Artificial Sequence:  Synthetic Peptide
YLPICSGLRV

SEQ ID NO: 5617 - protein, 10 aa, Artificial Sequence
  Description of Artificial Sequence:  Synthetic Peptide
YPYLPICSGL

SEQ ID NO: 5618 - protein, 10 aa, Artificial Sequence
  Description of Artificial Sequence:  Synthetic Peptide
YPYLPICSGL

SEQ ID NO: 5619 - protein, 10 aa, Artificial Sequence
  Description of Artificial Sequence:  Synthetic Peptide
SAAVDSADPY

SEQ ID NO: 5620 - protein, 10 aa, Artificial Sequence
  Description of Artificial Sequence:  Synthetic Peptide
LQRIYAPPPL

SEQ ID NO: 5621 - protein, 9 aa, Artificial Sequence
  Description of Artificial Sequence:  Synthetic Peptide
NATVCKGSL

SEQ ID NO: 5622 - protein, 10 aa, Artificial Sequence
  Description of Artificial Sequence:  Synthetic Peptide
SLSGTWGSTR

SEQ ID NO: 5623 - protein, 9 aa, Artificial Sequence
  Description of Artificial Sequence:  Synthetic Peptide
NASSTASCL

SEQ ID NO: 5624 - protein, 9 aa, Artificial Sequence
  Description of Artificial Sequence:  Synthetic Peptide
GLEAVRHSY

SEQ ID NO: 5625 - protein, 9 aa, Artificial Sequence
  Description of Artificial Sequence:  Synthetic Peptide
GLEAVRHSY

SEQ ID NO: 5626 - protein, 9 aa, Artificial Sequence
  Description of Artificial Sequence:  Synthetic Peptide
MALPGGGGL

SEQ ID NO: 5627 - protein, 10 aa, Artificial Sequence
  Description of Artificial Sequence:  Synthetic Peptide
ICRETSYGTL

SEQ ID NO: 5628 - protein, 10 aa, Artificial Sequence
  Description of Artificial Sequence:  Synthetic Peptide
ICRETSYGTL

SEQ ID NO: 5629 - protein, 9 aa, Artificial Sequence
  Description of Artificial Sequence:  Synthetic Peptide
VSLSFVFTA

SEQ ID NO: 5630 - protein, 9 aa, Artificial Sequence
  Description of Artificial Sequence:  Synthetic Peptide
LASGNGVSL

SEQ ID NO: 5631 - protein, 10 aa, Artificial Sequence
  Description of Artificial Sequence:  Synthetic Peptide
SLSFVFTAQL

SEQ ID NO: 5632 - protein, 10 aa, Artificial Sequence
  Description of Artificial Sequence:  Synthetic Peptide
GVSLSFVFTA

SEQ ID NO: 5633 - protein, 10 aa, Artificial Sequence
  Description of Artificial Sequence:  Synthetic Peptide
RLASGNGVSL

SEQ ID NO: 5634 - protein, 9 aa, Artificial Sequence
  Description of Artificial Sequence:  Synthetic Peptide
WMMLPSQEL

SEQ ID NO: 5635 - protein, 9 aa, Artificial Sequence
  Description of Artificial Sequence:  Synthetic Peptide
IMTIRTQIV

SEQ ID NO: 5636 - protein, 9 aa, Artificial Sequence
  Description of Artificial Sequence:  Synthetic Peptide
IMAGRSSGL

SEQ ID NO: 5637 - protein, 9 aa, Artificial Sequence
  Description of Artificial Sequence:  Synthetic Peptide
YLVIASVKA

SEQ ID NO: 5638 - protein, 9 aa, Artificial Sequence
  Description of Artificial Sequence:  Synthetic Peptide
MMLPSQELT

SEQ ID NO: 5639 - protein, 9 aa, Artificial Sequence
  Description of Artificial Sequence:  Synthetic Peptide
VIGVVGSLV

SEQ ID NO: 5640 - protein, 9 aa, Artificial Sequence
  Description of Artificial Sequence:  Synthetic Peptide
SQAARVIGV

SEQ ID NO: 5641 - protein, 9 aa, Artificial Sequence
  Description of Artificial Sequence:  Synthetic Peptide
SKLRFWFRV

SEQ ID NO: 5642 - protein, 9 aa, Artificial Sequence
  Description of Artificial Sequence:  Synthetic Peptide
RVIGVVGSL

SEQ ID NO: 5643 - protein, 9 aa, Artificial Sequence
  Description of Artificial Sequence:  Synthetic Peptide
RSPGGAEYL

SEQ ID NO: 5644 - protein, 9 aa, Artificial Sequence
  Description of Artificial Sequence:  Synthetic Peptide
KYRRRPRES

SEQ ID NO: 5645 - protein, 9 aa, Artificial Sequence
  Description of Artificial Sequence:  Synthetic Peptide
GLTEYTAPY

SEQ ID NO: 5646 - protein, 9 aa, Artificial Sequence
  Description of Artificial Sequence:  Synthetic Peptide
GVVGSLVKK

SEQ ID NO: 5647 - protein, 9 aa, Artificial Sequence
  Description of Artificial Sequence:  Synthetic Peptide
AALHAARAL

SEQ ID NO: 5648 - protein, 9 aa, Artificial Sequence
  Description of Artificial Sequence:  Synthetic Peptide
RVIGVVGSL

SEQ ID NO: 5649 - protein, 9 aa, Artificial Sequence
  Description of Artificial Sequence:  Synthetic Peptide
IVGAYWMML

SEQ ID NO: 5650 - protein, 9 aa, Artificial Sequence
  Description of Artificial Sequence:  Synthetic Peptide
LVIASVKAL

SEQ ID NO: 5651 - protein, 9 aa, Artificial Sequence
  Description of Artificial Sequence:  Synthetic Peptide
EALTARARL

SEQ ID NO: 5652 - protein, 9 aa, Artificial Sequence
  Description of Artificial Sequence:  Synthetic Peptide
WMMLPSQEL

SEQ ID NO: 5653 - protein, 9 aa, Artificial Sequence
  Description of Artificial Sequence:  Synthetic Peptide
TARARLFHA

SEQ ID NO: 5654 - protein, 9 aa, Artificial Sequence
  Description of Artificial Sequence:  Synthetic Peptide
APYISKLRF

SEQ ID NO: 5655 - protein, 9 aa, Artificial Sequence
  Description of Artificial Sequence:  Synthetic Peptide
RSSSSLPWL

SEQ ID NO: 5656 - protein, 9 aa, Artificial Sequence
  Description of Artificial Sequence:  Synthetic Peptide
RSPGGAEYL

SEQ ID NO: 5657 - protein, 9 aa, Artificial Sequence
  Description of Artificial Sequence:  Synthetic Peptide
SSLPWLSEM

SEQ ID NO: 5658 - protein, 9 aa, Artificial Sequence
  Description of Artificial Sequence:  Synthetic Peptide
SSPCSLSIM

SEQ ID NO: 5659 - protein, 9 aa, Artificial Sequence
  Description of Artificial Sequence:  Synthetic Peptide
RESSATDTF

SEQ ID NO: 5660 - protein, 9 aa, Artificial Sequence
  Description of Artificial Sequence:  Synthetic Peptide
QDVISSKSY

SEQ ID NO: 5661 - protein, 9 aa, Artificial Sequence
  Description of Artificial Sequence:  Synthetic Peptide
MEKKWVIMT

SEQ ID NO: 5662 - protein, 9 aa, Artificial Sequence
  Description of Artificial Sequence:  Synthetic Peptide
AEYLVIASV

SEQ ID NO: 5663 - protein, 9 aa, Artificial Sequence
  Description of Artificial Sequence:  Synthetic Peptide
GECLTVSQA

SEQ ID NO: 5664 - protein, 9 aa, Artificial Sequence
  Description of Artificial Sequence:  Synthetic Peptide
FEEQDVISS

SEQ ID NO: 5665 - protein, 10 aa, Artificial Sequence
  Description of Artificial Sequence:  Synthetic Peptide
MSEALTARAR

SEQ ID NO: 5666 - protein, 10 aa, Artificial Sequence
  Description of Artificial Sequence:  Synthetic Peptide
GLTEYTAPYI

SEQ ID NO: 5667 - protein, 10 aa, Artificial Sequence
  Description of Artificial Sequence:  Synthetic Peptide
YLVIASVKAL

SEQ ID NO: 5668 - protein, 10 aa, Artificial Sequence
  Description of Artificial Sequence:  Synthetic Peptide
CLTVSQAARV

SEQ ID NO: 5669 - protein, 10 aa, Artificial Sequence
  Description of Artificial Sequence:  Synthetic Peptide
WMMLPSQELT

SEQ ID NO: 5670 - protein, 10 aa, Artificial Sequence
  Description of Artificial Sequence:  Synthetic Peptide
MMSEALTARA

SEQ ID NO: 5671 - protein, 10 aa, Artificial Sequence
  Description of Artificial Sequence:  Synthetic Peptide
VIMTIRTQIV

SEQ ID NO: 5672 - protein, 10 aa, Artificial Sequence
  Description of Artificial Sequence:  Synthetic Peptide
WASSMEKKWV

SEQ ID NO: 5673 - protein, 10 aa, Artificial Sequence
  Description of Artificial Sequence:  Synthetic Peptide
SIMAGRSSGL

SEQ ID NO: 5674 - protein, 10 aa, Artificial Sequence
  Description of Artificial Sequence:  Synthetic Peptide
EYTAPYISKL

SEQ ID NO: 5675 - protein, 10 aa, Artificial Sequence
  Description of Artificial Sequence:  Synthetic Peptide
PYISKLRFWF

SEQ ID NO: 5676 - protein, 10 aa, Artificial Sequence
  Description of Artificial Sequence:  Synthetic Peptide
KYRRRPRESS

SEQ ID NO: 5677 - protein, 10 aa, Artificial Sequence
  Description of Artificial Sequence:  Synthetic Peptide
ALRFRSSSSL

SEQ ID NO: 5678 - protein, 10 aa, Artificial Sequence
  Description of Artificial Sequence:  Synthetic Peptide
ALRGGAPSFL

SEQ ID NO: 5679 - protein, 10 aa, Artificial Sequence
  Description of Artificial Sequence:  Synthetic Peptide
TARARLFHAL

SEQ ID NO: 5680 - protein, 10 aa, Artificial Sequence
  Description of Artificial Sequence:  Synthetic Peptide
IVGSTIPAAL

SEQ ID NO: 5681 - protein, 10 aa, Artificial Sequence
  Description of Artificial Sequence:  Synthetic Peptide
RPRESSATDT

SEQ ID NO: 5682 - protein, 10 aa, Artificial Sequence
  Description of Artificial Sequence:  Synthetic Peptide
AALHAARALM

SEQ ID NO: 5683 - protein, 10 aa, Artificial Sequence
  Description of Artificial Sequence:  Synthetic Peptide
SIMAGRSSGL

SEQ ID NO: 5684 - protein, 10 aa, Artificial Sequence
  Description of Artificial Sequence:  Synthetic Peptide
TARARLFHAL

SEQ ID NO: 5685 - protein, 10 aa, Artificial Sequence
  Description of Artificial Sequence:  Synthetic Peptide
RPRESSATDT

SEQ ID NO: 5686 - protein, 10 aa, Artificial Sequence
  Description of Artificial Sequence:  Synthetic Peptide
SSMEKKWVIM

SEQ ID NO: 5687 - protein, 10 aa, Artificial Sequence
  Description of Artificial Sequence:  Synthetic Peptide
ATRESSWGEY

SEQ ID NO: 5688 - protein, 10 aa, Artificial Sequence
  Description of Artificial Sequence:  Synthetic Peptide
SPGGAEYLVI

SEQ ID NO: 5689 - protein, 10 aa, Artificial Sequence
  Description of Artificial Sequence:  Synthetic Peptide
APYISKLRFW

SEQ ID NO: 5690 - protein, 10 aa, Artificial Sequence
  Description of Artificial Sequence:  Synthetic Peptide
SSSLPWLSEM

SEQ ID NO: 5691 - protein, 10 aa, Artificial Sequence
  Description of Artificial Sequence:  Synthetic Peptide
ASSPCSLSIM

SEQ ID NO: 5692 - protein, 10 aa, Artificial Sequence
  Description of Artificial Sequence:  Synthetic Peptide
SEALTARARL

SEQ ID NO: 5693 - protein, 10 aa, Artificial Sequence
  Description of Artificial Sequence:  Synthetic Peptide
SGLTEYTAPY

SEQ ID NO: 5694 - protein, 10 aa, Artificial Sequence
  Description of Artificial Sequence:  Synthetic Peptide
AGRSSGLTEY

SEQ ID NO: 5695 - protein, 9 aa, Artificial Sequence
  Description of Artificial Sequence:  Synthetic Peptide
KTPLARQRL

SEQ ID NO: 5696 - protein, 9 aa, Artificial Sequence
  Description of Artificial Sequence:  Synthetic Peptide
MVFPMLVVK

SEQ ID NO: 5697 - protein, 10 aa, Artificial Sequence
  Description of Artificial Sequence:  Synthetic Peptide
MLVVKTPLAR

SEQ ID NO: 5698 - protein, 10 aa, Artificial Sequence
  Description of Artificial Sequence:  Synthetic Peptide
FPMLVVKTPL

SEQ ID NO: 5699 - protein, 10 aa, Artificial Sequence
  Description of Artificial Sequence:  Synthetic Peptide
FPMLVVKTPL

SEQ ID NO: 5700 - protein, 9 aa, Artificial Sequence
  Description of Artificial Sequence:  Synthetic Peptide
VLMSLSVTV

SEQ ID NO: 5701 - protein, 9 aa, Artificial Sequence
  Description of Artificial Sequence:  Synthetic Peptide
YENPIGSFL

SEQ ID NO: 5702 - protein, 9 aa, Artificial Sequence
  Description of Artificial Sequence:  Synthetic Peptide
SYENPIGSF

SEQ ID NO: 5703 - protein, 9 aa, Artificial Sequence
  Description of Artificial Sequence:  Synthetic Peptide
SLSVTVESK

SEQ ID NO: 5704 - protein, 9 aa, Artificial Sequence
  Description of Artificial Sequence:  Synthetic Peptide
FLLPQALRR

SEQ ID NO: 5705 - protein, 9 aa, Artificial Sequence
  Description of Artificial Sequence:  Synthetic Peptide
KSTRSAGEY

SEQ ID NO: 5706 - protein, 9 aa, Artificial Sequence
  Description of Artificial Sequence:  Synthetic Peptide
VESKQRVSY

SEQ ID NO: 5707 - protein, 10 aa, Artificial Sequence
  Description of Artificial Sequence:  Synthetic Peptide
TVESKQRVSY

SEQ ID NO: 5708 - protein, 10 aa, Artificial Sequence
  Description of Artificial Sequence:  Synthetic Peptide
SVLMSLSVTV

SEQ ID NO: 5709 - protein, 10 aa, Artificial Sequence
  Description of Artificial Sequence:  Synthetic Peptide
YENPIGSFLL

SEQ ID NO: 5710 - protein, 10 aa, Artificial Sequence
  Description of Artificial Sequence:  Synthetic Peptide
SYENPIGSFL

SEQ ID NO: 5711 - protein, 10 aa, Artificial Sequence
  Description of Artificial Sequence:  Synthetic Peptide
VSYENPIGSF

SEQ ID NO: 5712 - protein, 10 aa, Artificial Sequence
  Description of Artificial Sequence:  Synthetic Peptide
YENPIGSFLL

SEQ ID NO: 5713 - protein, 9 aa, Artificial Sequence
  Description of Artificial Sequence:  Synthetic Peptide
WLTAPLDKL

SEQ ID NO: 5714 - protein, 9 aa, Artificial Sequence
  Description of Artificial Sequence:  Synthetic Peptide
FLAMAVVSI

SEQ ID NO: 5715 - protein, 9 aa, Artificial Sequence
  Description of Artificial Sequence:  Synthetic Peptide
AMAVVSIGV

SEQ ID NO: 5716 - protein, 9 aa, Artificial Sequence
  Description of Artificial Sequence:  Synthetic Peptide
ALTLEAARL

SEQ ID NO: 5717 - protein, 9 aa, Artificial Sequence
  Description of Artificial Sequence:  Synthetic Peptide
FFPPLAGSI

SEQ ID NO: 5718 - protein, 9 aa, Artificial Sequence
  Description of Artificial Sequence:  Synthetic Peptide
FAPNPYRDL

SEQ ID NO: 5719 - protein, 9 aa, Artificial Sequence
  Description of Artificial Sequence:  Synthetic Peptide
QASSTERSL

SEQ ID NO: 5720 - protein, 9 aa, Artificial Sequence
  Description of Artificial Sequence:  Synthetic Peptide
ALTLEAARL

SEQ ID NO: 5721 - protein, 9 aa, Artificial Sequence
  Description of Artificial Sequence:  Synthetic Peptide
NPYRDLAEW

SEQ ID NO: 5722 - protein, 9 aa, Artificial Sequence
  Description of Artificial Sequence:  Synthetic Peptide
SSTERSLAL

SEQ ID NO: 5723 - protein, 9 aa, Artificial Sequence
  Description of Artificial Sequence:  Synthetic Peptide
LEAARLTSC

SEQ ID NO: 5724 - protein, 10 aa, Artificial Sequence
  Description of Artificial Sequence:  Synthetic Peptide
SFAPNPYRDL

SEQ ID NO: 5725 - protein, 10 aa, Artificial Sequence
  Description of Artificial Sequence:  Synthetic Peptide
RMWLTAPLDK

SEQ ID NO: 5726 - protein, 10 aa, Artificial Sequence
  Description of Artificial Sequence:  Synthetic Peptide
AQASSTERSL

SEQ ID NO: 5727 - protein, 10 aa, Artificial Sequence
  Description of Artificial Sequence:  Synthetic Peptide
AGSIQNTSFL

SEQ ID NO: 5728 - protein, 10 aa, Artificial Sequence
  Description of Artificial Sequence:  Synthetic Peptide
LALTLEAARL

SEQ ID NO: 5729 - protein, 10 aa, Artificial Sequence
  Description of Artificial Sequence:  Synthetic Peptide
ASSTERSLAL

SEQ ID NO: 5730 - protein, 10 aa, Artificial Sequence
  Description of Artificial Sequence:  Synthetic Peptide
APLDKLRTSF

SEQ ID NO: 5731 - protein, 10 aa, Artificial Sequence
  Description of Artificial Sequence:  Synthetic Peptide
RSSHTDRMWL

SEQ ID NO: 5732 - protein, 10 aa, Artificial Sequence
  Description of Artificial Sequence:  Synthetic Peptide
AEWGGVNAQA

SEQ ID NO: 5733 - protein, 9 aa, Artificial Sequence
  Description of Artificial Sequence:  Synthetic Peptide
RAPVQEYDM

SEQ ID NO: 5734 - protein, 9 aa, Artificial Sequence
  Description of Artificial Sequence:  Synthetic Peptide
SPSEGGADL

SEQ ID NO: 5735 - protein, 9 aa, Artificial Sequence
  Description of Artificial Sequence:  Synthetic Peptide
SPSEGGADL

SEQ ID NO: 5736 - protein, 9 aa, Artificial Sequence
  Description of Artificial Sequence:  Synthetic Peptide
VSPEGCWTL

SEQ ID NO: 5737 - protein, 10 aa, Artificial Sequence
  Description of Artificial Sequence:  Synthetic Peptide
DSDPASEAAV

SEQ ID NO: 5738 - protein, 10 aa, Artificial Sequence
  Description of Artificial Sequence:  Synthetic Peptide
TLSPPVSAPV

SEQ ID NO: 5739 - protein, 10 aa, Artificial Sequence
  Description of Artificial Sequence:  Synthetic Peptide
AVSPEGCWTL

SEQ ID NO: 5740 - protein, 10 aa, Artificial Sequence
  Description of Artificial Sequence:  Synthetic Peptide
AVSPEGCWTL

SEQ ID NO: 5741 - protein, 10 aa, Artificial Sequence
  Description of Artificial Sequence:  Synthetic Peptide
SPGSPSRGGM

SEQ ID NO: 5742 - protein, 10 aa, Artificial Sequence
  Description of Artificial Sequence:  Synthetic Peptide
SPGSPSRGGM

SEQ ID NO: 5743 - protein, 10 aa, Artificial Sequence
  Description of Artificial Sequence:  Synthetic Peptide
SEGGADLAGS

SEQ ID NO: 5744 - protein, 10 aa, Artificial Sequence
  Description of Artificial Sequence:  Synthetic Peptide
SEAAVSPEGC

SEQ ID NO: 5745 - protein, 9 aa, Artificial Sequence
  Description of Artificial Sequence:  Synthetic Peptide
VMWDGSVNM

SEQ ID NO: 5746 - protein, 9 aa, Artificial Sequence
  Description of Artificial Sequence:  Synthetic Peptide
SQSYAVLWV

SEQ ID NO: 5747 - protein, 9 aa, Artificial Sequence
  Description of Artificial Sequence:  Synthetic Peptide
VNMEANTSV

SEQ ID NO: 5748 - protein, 9 aa, Artificial Sequence
  Description of Artificial Sequence:  Synthetic Peptide
QSYAVLWVV

SEQ ID NO: 5749 - protein, 9 aa, Artificial Sequence
  Description of Artificial Sequence:  Synthetic Peptide
YAVLWVVQV

SEQ ID NO: 5750 - protein, 9 aa, Artificial Sequence
  Description of Artificial Sequence:  Synthetic Peptide
VLWVVQVAF

SEQ ID NO: 5751 - protein, 9 aa, Artificial Sequence
  Description of Artificial Sequence:  Synthetic Peptide
LACEGGDPL

SEQ ID NO: 5752 - protein, 9 aa, Artificial Sequence
  Description of Artificial Sequence:  Synthetic Peptide
SIRVTSPPM

SEQ ID NO: 5753 - protein, 10 aa, Artificial Sequence
  Description of Artificial Sequence:  Synthetic Peptide
SQSYAVLWVV

SEQ ID NO: 5754 - protein, 10 aa, Artificial Sequence
  Description of Artificial Sequence:  Synthetic Peptide
ITLESDSIRV

SEQ ID NO: 5755 - protein, 10 aa, Artificial Sequence
  Description of Artificial Sequence:  Synthetic Peptide
AFKDGADSWL

SEQ ID NO: 5756 - protein, 10 aa, Artificial Sequence
  Description of Artificial Sequence:  Synthetic Peptide
VLWVVQVAFK

SEQ ID NO: 5757 - protein, 10 aa, Artificial Sequence
  Description of Artificial Sequence:  Synthetic Peptide
AVMWDGSVNM

SEQ ID NO: 5758 - protein, 10 aa, Artificial Sequence
  Description of Artificial Sequence:  Synthetic Peptide
ESRESRTITL

SEQ ID NO: 5759 - protein, 10 aa, Artificial Sequence
  Description of Artificial Sequence:  Synthetic Peptide
RVTSPPMKRL

SEQ ID NO: 5760 - protein, 10 aa, Artificial Sequence
  Description of Artificial Sequence:  Synthetic Peptide
STMSQSYAVL

SEQ ID NO: 5761 - protein, 10 aa, Artificial Sequence
  Description of Artificial Sequence:  Synthetic Peptide
ESRESRTITL

SEQ ID NO: 5762 - protein, 10 aa, Artificial Sequence
  Description of Artificial Sequence:  Synthetic Peptide
ESRESRTITL

SEQ ID NO: 5763 - protein, 10 aa, Artificial Sequence
  Description of Artificial Sequence:  Synthetic Peptide
DSIRVTSPPM

SEQ ID NO: 5764 - protein, 9 aa, Artificial Sequence
  Description of Artificial Sequence:  Synthetic Peptide
SLLSKLVIV

SEQ ID NO: 5765 - protein, 9 aa, Artificial Sequence
  Description of Artificial Sequence:  Synthetic Peptide
IVSELNTCV

SEQ ID NO: 5766 - protein, 9 aa, Artificial Sequence
  Description of Artificial Sequence:  Synthetic Peptide
QVFGPVIFM

SEQ ID NO: 5767 - protein, 9 aa, Artificial Sequence
  Description of Artificial Sequence:  Synthetic Peptide
APHEHRVVM

SEQ ID NO: 5768 - protein, 9 aa, Artificial Sequence
  Description of Artificial Sequence:  Synthetic Peptide
TPVPAHTPL

SEQ ID NO: 5769 - protein, 9 aa, Artificial Sequence
  Description of Artificial Sequence:  Synthetic Peptide
VPKRTWPEM

SEQ ID NO: 5770 - protein, 9 aa, Artificial Sequence
  Description of Artificial Sequence:  Synthetic Peptide
SVIQACSLL

SEQ ID NO: 5771 - protein, 9 aa, Artificial Sequence
  Description of Artificial Sequence:  Synthetic Peptide
QACSLLSKL

SEQ ID NO: 5772 - protein, 9 aa, Artificial Sequence
  Description of Artificial Sequence:  Synthetic Peptide
EMKGRPGIL

SEQ ID NO: 5773 - protein, 9 aa, Artificial Sequence
  Description of Artificial Sequence:  Synthetic Peptide
VPKRTWPEM

SEQ ID NO: 5774 - protein, 9 aa, Artificial Sequence
  Description of Artificial Sequence:  Synthetic Peptide
APHEHRVVM

SEQ ID NO: 5775 - protein, 9 aa, Artificial Sequence
  Description of Artificial Sequence:  Synthetic Peptide
RPGILGSNF

SEQ ID NO: 5776 - protein, 9 aa, Artificial Sequence
  Description of Artificial Sequence:  Synthetic Peptide
TPVPAHTPL

SEQ ID NO: 5777 - protein, 10 aa, Artificial Sequence
  Description of Artificial Sequence:  Synthetic Peptide
VSELNTCVTR

SEQ ID NO: 5778 - protein, 10 aa, Artificial Sequence
  Description of Artificial Sequence:  Synthetic Peptide
QVFGPVIFMV

SEQ ID NO: 5779 - protein, 10 aa, Artificial Sequence
  Description of Artificial Sequence:  Synthetic Peptide
KLVIVSELNT

SEQ ID NO: 5780 - protein, 10 aa, Artificial Sequence
  Description of Artificial Sequence:  Synthetic Peptide
VIVSELNTCV

SEQ ID NO: 5781 - protein, 10 aa, Artificial Sequence
  Description of Artificial Sequence:  Synthetic Peptide
FADSQFLKSV

SEQ ID NO: 5782 - protein, 10 aa, Artificial Sequence
  Description of Artificial Sequence:  Synthetic Peptide
EMFAPHEHRV

SEQ ID NO: 5783 - protein, 10 aa, Artificial Sequence
  Description of Artificial Sequence:  Synthetic Peptide
PLYPFWQEMK

SEQ ID NO: 5784 - protein, 10 aa, Artificial Sequence
  Description of Artificial Sequence:  Synthetic Peptide
TPLYPFWQEM

SEQ ID NO: 5785 - protein, 10 aa, Artificial Sequence
  Description of Artificial Sequence:  Synthetic Peptide
VPKRTWPEMF

SEQ ID NO: 5786 - protein, 10 aa, Artificial Sequence
  Description of Artificial Sequence:  Synthetic Peptide
TPLYPFWQEM

SEQ ID NO: 5787 - protein, 10 aa, Artificial Sequence
  Description of Artificial Sequence:  Synthetic Peptide
TPVPAHTPLY

SEQ ID NO: 5788 - protein, 10 aa, Artificial Sequence
  Description of Artificial Sequence:  Synthetic Peptide
VPAHTPLYPF

SEQ ID NO: 5789 - protein, 10 aa, Artificial Sequence
  Description of Artificial Sequence:  Synthetic Peptide
VPCHMFRQVF

SEQ ID NO: 5790 - protein, 10 aa, Artificial Sequence
  Description of Artificial Sequence:  Synthetic Peptide
LSKLVIVSEL

SEQ ID NO: 5791 - protein, 10 aa, Artificial Sequence
  Description of Artificial Sequence:  Synthetic Peptide
DSQFLKSVRM

SEQ ID NO: 5792 - protein, 10 aa, Artificial Sequence
  Description of Artificial Sequence:  Synthetic Peptide
SELNTCVTRS

SEQ ID NO: 5793 - protein, 10 aa, Artificial Sequence
  Description of Artificial Sequence:  Synthetic Peptide
TPVPAHTPLY

SEQ ID NO: 5794 - protein, 9 aa, Artificial Sequence
  Description of Artificial Sequence:  Synthetic Peptide
MMFKRMVVL

SEQ ID NO: 5795 - protein, 9 aa, Artificial Sequence
  Description of Artificial Sequence:  Synthetic Peptide
CMAGCMSWA

SEQ ID NO: 5796 - protein, 9 aa, Artificial Sequence
  Description of Artificial Sequence:  Synthetic Peptide
ILPRPILPT

SEQ ID NO: 5797 - protein, 9 aa, Artificial Sequence
  Description of Artificial Sequence:  Synthetic Peptide
CMPLMKFHM

SEQ ID NO: 5798 - protein, 9 aa, Artificial Sequence
  Description of Artificial Sequence:  Synthetic Peptide
KIAGRRFTT

SEQ ID NO: 5799 - protein, 9 aa, Artificial Sequence
  Description of Artificial Sequence:  Synthetic Peptide
ILDLSISAI

SEQ ID NO: 5800 - protein, 9 aa, Artificial Sequence
  Description of Artificial Sequence:  Synthetic Peptide
SILDLSISA

SEQ ID NO: 5801 - protein, 9 aa, Artificial Sequence
  Description of Artificial Sequence:  Synthetic Peptide
RYCMPLMKF

SEQ ID NO: 5802 - protein, 9 aa, Artificial Sequence
  Description of Artificial Sequence:  Synthetic Peptide
CPSSMRAAL

SEQ ID NO: 5803 - protein, 9 aa, Artificial Sequence
  Description of Artificial Sequence:  Synthetic Peptide
SPARYCMPL

SEQ ID NO: 5804 - protein, 9 aa, Artificial Sequence
  Description of Artificial Sequence:  Synthetic Peptide
MVVLVGSGL

SEQ ID NO: 5805 - protein, 9 aa, Artificial Sequence
  Description of Artificial Sequence:  Synthetic Peptide
LPRPILPTA

SEQ ID NO: 5806 - protein, 9 aa, Artificial Sequence
  Description of Artificial Sequence:  Synthetic Peptide
HPPMMFKRM

SEQ ID NO: 5807 - protein, 9 aa, Artificial Sequence
  Description of Artificial Sequence:  Synthetic Peptide
PARTSTNIL

SEQ ID NO: 5808 - protein, 9 aa, Artificial Sequence
  Description of Artificial Sequence:  Synthetic Peptide
ACCRRPSIL

SEQ ID NO: 5809 - protein, 9 aa, Artificial Sequence
  Description of Artificial Sequence:  Synthetic Peptide
ACCRRPSIL

SEQ ID NO: 5810 - protein, 9 aa, Artificial Sequence
  Description of Artificial Sequence:  Synthetic Peptide
HPPMMFKRM

SEQ ID NO: 5811 - protein, 9 aa, Artificial Sequence
  Description of Artificial Sequence:  Synthetic Peptide
RAPEMPAPY

SEQ ID NO: 5812 - protein, 9 aa, Artificial Sequence
  Description of Artificial Sequence:  Synthetic Peptide
SPARYCMPL

SEQ ID NO: 5813 - protein, 9 aa, Artificial Sequence
  Description of Artificial Sequence:  Synthetic Peptide
CPSSMRAAL

SEQ ID NO: 5814 - protein, 9 aa, Artificial Sequence
  Description of Artificial Sequence:  Synthetic Peptide
RPSILDLSI

SEQ ID NO: 5815 - protein, 9 aa, Artificial Sequence
  Description of Artificial Sequence:  Synthetic Peptide
SSTEGFSPL

SEQ ID NO: 5816 - protein, 9 aa, Artificial Sequence
  Description of Artificial Sequence:  Synthetic Peptide
SSISSKASY

SEQ ID NO: 5817 - protein, 9 aa, Artificial Sequence
  Description of Artificial Sequence:  Synthetic Peptide
SSISSKASY

SEQ ID NO: 5818 - protein, 9 aa, Artificial Sequence
  Description of Artificial Sequence:  Synthetic Peptide
VESPARYCM

SEQ ID NO: 5819 - protein, 9 aa, Artificial Sequence
  Description of Artificial Sequence:  Synthetic Peptide
GDKIAGRRF

SEQ ID NO: 5820 - protein, 10 aa, Artificial Sequence
  Description of Artificial Sequence:  Synthetic Peptide
STEGFSPLMI

SEQ ID NO: 5821 - protein, 10 aa, Artificial Sequence
  Description of Artificial Sequence:  Synthetic Peptide
ILDLSISAIR

SEQ ID NO: 5822 - protein, 10 aa, Artificial Sequence
  Description of Artificial Sequence:  Synthetic Peptide
MMFKRMVVLV

SEQ ID NO: 5823 - protein, 10 aa, Artificial Sequence
  Description of Artificial Sequence:  Synthetic Peptide
SILDLSISAI

SEQ ID NO: 5824 - protein, 10 aa, Artificial Sequence
  Description of Artificial Sequence:  Synthetic Peptide
CMAGCMSWAC

SEQ ID NO: 5825 - protein, 10 aa, Artificial Sequence
  Description of Artificial Sequence:  Synthetic Peptide
GLVNAALKAI

SEQ ID NO: 5826 - protein, 10 aa, Artificial Sequence
  Description of Artificial Sequence:  Synthetic Peptide
AIWEANHPPM

SEQ ID NO: 5827 - protein, 10 aa, Artificial Sequence
  Description of Artificial Sequence:  Synthetic Peptide
ILPRPILPTA

SEQ ID NO: 5828 - protein, 10 aa, Artificial Sequence
  Description of Artificial Sequence:  Synthetic Peptide
VLVGSGLVNA

SEQ ID NO: 5829 - protein, 10 aa, Artificial Sequence
  Description of Artificial Sequence:  Synthetic Peptide
RMVVLVGSGL

SEQ ID NO: 5830 - protein, 10 aa, Artificial Sequence
  Description of Artificial Sequence:  Synthetic Peptide
RFTTSSTEGF

SEQ ID NO: 5831 - protein, 10 aa, Artificial Sequence
  Description of Artificial Sequence:  Synthetic Peptide
RMVVLVGSGL

SEQ ID NO: 5832 - protein, 10 aa, Artificial Sequence
  Description of Artificial Sequence:  Synthetic Peptide
RCPSSMRAAL

SEQ ID NO: 5833 - protein, 10 aa, Artificial Sequence
  Description of Artificial Sequence:  Synthetic Peptide
LPTAAPTRPL

SEQ ID NO: 5834 - protein, 10 aa, Artificial Sequence
  Description of Artificial Sequence:  Synthetic Peptide
MPLMKFHMCL

SEQ ID NO: 5835 - protein, 10 aa, Artificial Sequence
  Description of Artificial Sequence:  Synthetic Peptide
YPARTSTNIL

SEQ ID NO: 5836 - protein, 10 aa, Artificial Sequence
  Description of Artificial Sequence:  Synthetic Peptide
CCRRPSILDL

SEQ ID NO: 5837 - protein, 10 aa, Artificial Sequence
  Description of Artificial Sequence:  Synthetic Peptide
LPRPILPTAA

SEQ ID NO: 5838 - protein, 10 aa, Artificial Sequence
  Description of Artificial Sequence:  Synthetic Peptide
SPARYCMPLM

SEQ ID NO: 5839 - protein, 10 aa, Artificial Sequence
  Description of Artificial Sequence:  Synthetic Peptide
VACCRRPSIL

SEQ ID NO: 5840 - protein, 10 aa, Artificial Sequence
  Description of Artificial Sequence:  Synthetic Peptide
ILKATRAPEM

SEQ ID NO: 5841 - protein, 10 aa, Artificial Sequence
  Description of Artificial Sequence:  Synthetic Peptide
VACCRRPSIL

SEQ ID NO: 5842 - protein, 10 aa, Artificial Sequence
  Description of Artificial Sequence:  Synthetic Peptide
CCRRPSILDL

SEQ ID NO: 5843 - protein, 10 aa, Artificial Sequence
  Description of Artificial Sequence:  Synthetic Peptide
SPARYCMPLM

SEQ ID NO: 5844 - protein, 10 aa, Artificial Sequence
  Description of Artificial Sequence:  Synthetic Peptide
YPARTSTNIL

SEQ ID NO: 5845 - protein, 10 aa, Artificial Sequence
  Description of Artificial Sequence:  Synthetic Peptide
LPTAAPTRPL

SEQ ID NO: 5846 - protein, 10 aa, Artificial Sequence
  Description of Artificial Sequence:  Synthetic Peptide
MPLMKFHMCL

SEQ ID NO: 5847 - protein, 10 aa, Artificial Sequence
  Description of Artificial Sequence:  Synthetic Peptide
SSTEGFSPLM

SEQ ID NO: 5848 - protein, 10 aa, Artificial Sequence
  Description of Artificial Sequence:  Synthetic Peptide
KPVAPAGGAI

SEQ ID NO: 5849 - protein, 10 aa, Artificial Sequence
  Description of Artificial Sequence:  Synthetic Peptide
SSKASYKISL

SEQ ID NO: 5850 - protein, 10 aa, Artificial Sequence
  Description of Artificial Sequence:  Synthetic Peptide
CSILGHDDCM

SEQ ID NO: 5851 - protein, 10 aa, Artificial Sequence
  Description of Artificial Sequence:  Synthetic Peptide
ISAIRCPSSM

SEQ ID NO: 5852 - protein, 10 aa, Artificial Sequence
  Description of Artificial Sequence:  Synthetic Peptide
HSSISSKASY

SEQ ID NO: 5853 - protein, 10 aa, Artificial Sequence
  Description of Artificial Sequence:  Synthetic Peptide
WEANHPPMMF

SEQ ID NO: 5854 - protein, 10 aa, Artificial Sequence
  Description of Artificial Sequence:  Synthetic Peptide
KAIIDATAGF

SEQ ID NO: 5855 - protein, 9 aa, Artificial Sequence
  Description of Artificial Sequence:  Synthetic Peptide
RPMMEMQPV

SEQ ID NO: 5856 - protein, 9 aa, Artificial Sequence
  Description of Artificial Sequence:  Synthetic Peptide
RPMMEMQPV

SEQ ID NO: 5857 - protein, 9 aa, Artificial Sequence
  Description of Artificial Sequence:  Synthetic Peptide
CMHVAIYFV

SEQ ID NO: 5858 - protein, 9 aa, Artificial Sequence
  Description of Artificial Sequence:  Synthetic Peptide
AIYFVTGWV

SEQ ID NO: 5859 - protein, 9 aa, Artificial Sequence
  Description of Artificial Sequence:  Synthetic Peptide
RYRRGVGPV

SEQ ID NO: 5860 - protein, 9 aa, Artificial Sequence
  Description of Artificial Sequence:  Synthetic Peptide
GPVSVGFSL

SEQ ID NO: 5861 - protein, 9 aa, Artificial Sequence
  Description of Artificial Sequence:  Synthetic Peptide
APKRYRRGV

SEQ ID NO: 5862 - protein, 9 aa, Artificial Sequence
  Description of Artificial Sequence:  Synthetic Peptide
GPVSVGFSL

SEQ ID NO: 5863 - protein, 9 aa, Artificial Sequence
  Description of Artificial Sequence:  Synthetic Peptide
APKRYRRGV

SEQ ID NO: 5864 - protein, 9 aa, Artificial Sequence
  Description of Artificial Sequence:  Synthetic Peptide
TSHEGGGAF

SEQ ID NO: 5865 - protein, 10 aa, Artificial Sequence
  Description of Artificial Sequence:  Synthetic Peptide
ACMHVAIYFV

SEQ ID NO: 5866 - protein, 10 aa, Artificial Sequence
  Description of Artificial Sequence:  Synthetic Peptide
CMHVAIYFVT

SEQ ID NO: 5867 - protein, 10 aa, Artificial Sequence
  Description of Artificial Sequence:  Synthetic Peptide
RYRRGVGPVS

SEQ ID NO: 5868 - protein, 10 aa, Artificial Sequence
  Description of Artificial Sequence:  Synthetic Peptide
RSACMHVAIY

SEQ ID NO: 5869 - protein, 10 aa, Artificial Sequence
  Description of Artificial Sequence:  Synthetic Peptide
ISLVTAPKRY

SEQ ID NO: 5870 - protein, 10 aa, Artificial Sequence
  Description of Artificial Sequence:  Synthetic Peptide
RSACMHVAIY

SEQ ID NO: 5871 - protein, 10 aa, Artificial Sequence
  Description of Artificial Sequence:  Synthetic Peptide
ISLVTAPKRY

SEQ ID NO: 5872 - protein, 9 aa, Artificial Sequence
  Description of Artificial Sequence:  Synthetic Peptide
MTESKSPVY

SEQ ID NO: 5873 - protein, 9 aa, Artificial Sequence
  Description of Artificial Sequence:  Synthetic Peptide
VYPVIRASV

SEQ ID NO: 5874 - protein, 10 aa, Artificial Sequence
  Description of Artificial Sequence:  Synthetic Peptide
TESKSPVYPV

SEQ ID NO: 5875 - protein, 9 aa, Artificial Sequence
  Description of Artificial Sequence:  Synthetic Peptide
NIRCLPPLM

SEQ ID NO: 5876 - protein, 10 aa, Artificial Sequence
  Description of Artificial Sequence:  Synthetic Peptide
WQNIRCLPPL

SEQ ID NO: 5877 - protein, 10 aa, Artificial Sequence
  Description of Artificial Sequence:  Synthetic Peptide
FFEWQNIRCL

SEQ ID NO: 5878 - protein, 10 aa, Artificial Sequence
  Description of Artificial Sequence:  Synthetic Peptide
LPPLMEARGI

SEQ ID NO: 5879 - protein, 9 aa, Artificial Sequence
  Description of Artificial Sequence:  Synthetic Peptide
MLAWGVVTV

SEQ ID NO: 5880 - protein, 9 aa, Artificial Sequence
  Description of Artificial Sequence:  Synthetic Peptide
MPRMVVAST

SEQ ID NO: 5881 - protein, 9 aa, Artificial Sequence
  Description of Artificial Sequence:  Synthetic Peptide
VAVARTTSL

SEQ ID NO: 5882 - protein, 9 aa, Artificial Sequence
  Description of Artificial Sequence:  Synthetic Peptide
VAVARTTSL

SEQ ID NO: 5883 - protein, 10 aa, Artificial Sequence
  Description of Artificial Sequence:  Synthetic Peptide
VVTVPGGVAV

SEQ ID NO: 5884 - protein, 10 aa, Artificial Sequence
  Description of Artificial Sequence:  Synthetic Peptide
GVAVARTTSL

SEQ ID NO: 5885 - protein, 10 aa, Artificial Sequence
  Description of Artificial Sequence:  Synthetic Peptide
WSRTVPMPRM

SEQ ID NO: 5886 - protein, 10 aa, Artificial Sequence
  Description of Artificial Sequence:  Synthetic Peptide
WSRTVPMPRM

SEQ ID NO: 5887 - protein, 10 aa, Artificial Sequence
  Description of Artificial Sequence:  Synthetic Peptide
ASTEWHSSQM

SEQ ID NO: 5888 - protein, 10 aa, Artificial Sequence
  Description of Artificial Sequence:  Synthetic Peptide
VSAWSRTVPM

SEQ ID NO: 5889 - protein, 9 aa, Artificial Sequence
  Description of Artificial Sequence:  Synthetic Peptide
MLGLIPWAL

SEQ ID NO: 5890 - protein, 9 aa, Artificial Sequence
  Description of Artificial Sequence:  Synthetic Peptide
KSIDLATPL

SEQ ID NO: 5891 - protein, 9 aa, Artificial Sequence
  Description of Artificial Sequence:  Synthetic Peptide
GLGDSNAPR

SEQ ID NO: 5892 - protein, 9 aa, Artificial Sequence
  Description of Artificial Sequence:  Synthetic Peptide
TPLAHTAAL

SEQ ID NO: 5893 - protein, 9 aa, Artificial Sequence
  Description of Artificial Sequence:  Synthetic Peptide
DPLRVERGL

SEQ ID NO: 5894 - protein, 9 aa, Artificial Sequence
  Description of Artificial Sequence:  Synthetic Peptide
NAPRLSSFL

SEQ ID NO: 5895 - protein, 9 aa, Artificial Sequence
  Description of Artificial Sequence:  Synthetic Peptide
KSIDLATPL

SEQ ID NO: 5896 - protein, 9 aa, Artificial Sequence
  Description of Artificial Sequence:  Synthetic Peptide
DPLRVERGL

SEQ ID NO: 5897 - protein, 9 aa, Artificial Sequence
  Description of Artificial Sequence:  Synthetic Peptide
TPLAHTAAL

SEQ ID NO: 5898 - protein, 9 aa, Artificial Sequence
  Description of Artificial Sequence:  Synthetic Peptide
GPPDDPLRV

SEQ ID NO: 5899 - protein, 9 aa, Artificial Sequence
  Description of Artificial Sequence:  Synthetic Peptide
LSSFLRTGM

SEQ ID NO: 5900 - protein, 9 aa, Artificial Sequence
  Description of Artificial Sequence:  Synthetic Peptide
SNAPRLSSF

SEQ ID NO: 5901 - protein, 10 aa, Artificial Sequence
  Description of Artificial Sequence:  Synthetic Peptide
GLGDSNAPRL

SEQ ID NO: 5902 - protein, 10 aa, Artificial Sequence
  Description of Artificial Sequence:  Synthetic Peptide
ALNKPTACPL

SEQ ID NO: 5903 - protein, 10 aa, Artificial Sequence
  Description of Artificial Sequence:  Synthetic Peptide
GMTSAFRVTR

SEQ ID NO: 5904 - protein, 10 aa, Artificial Sequence
  Description of Artificial Sequence:  Synthetic Peptide
APRLSSFLRT

SEQ ID NO: 5905 - protein, 10 aa, Artificial Sequence
  Description of Artificial Sequence:  Synthetic Peptide
ALNKPTACPL

SEQ ID NO: 5906 - protein, 10 aa, Artificial Sequence
  Description of Artificial Sequence:  Synthetic Peptide
ATPLAHTAAL

SEQ ID NO: 5907 - protein, 8 aa, Artificial Sequence
  Description of Artificial Sequence:  Synthetic Peptide
APRRPRVC

SEQ ID NO: 5908 - protein, 9 aa, Artificial Sequence
  Description of Artificial Sequence:  Synthetic Peptide
TMTFFSIGL

SEQ ID NO: 5909 - protein, 9 aa, Artificial Sequence
  Description of Artificial Sequence:  Synthetic Peptide
TARSRKPWA

SEQ ID NO: 5910 - protein, 10 aa, Artificial Sequence
  Description of Artificial Sequence:  Synthetic Peptide
APHTMTFFSI

SEQ ID NO: 5911 - protein, 10 aa, Artificial Sequence
  Description of Artificial Sequence:  Synthetic Peptide
HTMTFFSIGL

SEQ ID NO: 5912 - protein, 10 aa, Artificial Sequence
  Description of Artificial Sequence:  Synthetic Peptide
TARSRKPWAA

SEQ ID NO: 5913 - protein, 9 aa, Artificial Sequence
  Description of Artificial Sequence:  Synthetic Peptide
VINSIWIYL

SEQ ID NO: 5914 - protein, 9 aa, Artificial Sequence
  Description of Artificial Sequence:  Synthetic Peptide
YLAPARCLT

SEQ ID NO: 5915 - protein, 9 aa, Artificial Sequence
  Description of Artificial Sequence:  Synthetic Peptide
SIWIYLAPA

SEQ ID NO: 5916 - protein, 9 aa, Artificial Sequence
  Description of Artificial Sequence:  Synthetic Peptide
WIYLAPARC

SEQ ID NO: 5917 - protein, 9 aa, Artificial Sequence
  Description of Artificial Sequence:  Synthetic Peptide
IYLAPARCL

SEQ ID NO: 5918 - protein, 9 aa, Artificial Sequence
  Description of Artificial Sequence:  Synthetic Peptide
APARCLTRV

SEQ ID NO: 5919 - protein, 10 aa, Artificial Sequence
  Description of Artificial Sequence:  Synthetic Peptide
MVINSIWIYL

SEQ ID NO: 5920 - protein, 10 aa, Artificial Sequence
  Description of Artificial Sequence:  Synthetic Peptide
YLAPARCLTR

SEQ ID NO: 5921 - protein, 10 aa, Artificial Sequence
  Description of Artificial Sequence:  Synthetic Peptide
MVINSIWIYL

SEQ ID NO: 5922 - protein, 9 aa, Artificial Sequence
  Description of Artificial Sequence:  Synthetic Peptide
LAECKMMSF

SEQ ID NO: 5923 - protein, 9 aa, Artificial Sequence
  Description of Artificial Sequence:  Synthetic Peptide
KMMSFSSAA

SEQ ID NO: 5924 - protein, 9 aa, Artificial Sequence
  Description of Artificial Sequence:  Synthetic Peptide
ILASASNRK

SEQ ID NO: 5925 - protein, 9 aa, Artificial Sequence
  Description of Artificial Sequence:  Synthetic Peptide
ALAALAECK

SEQ ID NO: 5926 - protein, 10 aa, Artificial Sequence
  Description of Artificial Sequence:  Synthetic Peptide
MMSIQRHAQI

SEQ ID NO: 5927 - protein, 10 aa, Artificial Sequence
  Description of Artificial Sequence:  Synthetic Peptide
SSAASAWPSM

SEQ ID NO: 5928 - protein, 10 aa, Artificial Sequence
  Description of Artificial Sequence:  Synthetic Peptide
AECKMMSFSS

SEQ ID NO: 5929 - protein, 9 aa, Artificial Sequence
  Description of Artificial Sequence:  Synthetic Peptide
VLFSRKTSV

SEQ ID NO: 5930 - protein, 9 aa, Artificial Sequence
  Description of Artificial Sequence:  Synthetic Peptide
VLVNPVPFI

SEQ ID NO: 5931 - protein, 9 aa, Artificial Sequence
  Description of Artificial Sequence:  Synthetic Peptide
FSRKTSVSL

SEQ ID NO: 5932 - protein, 9 aa, Artificial Sequence
  Description of Artificial Sequence:  Synthetic Peptide
QAPRGGLVL

SEQ ID NO: 5933 - protein, 9 aa, Artificial Sequence
  Description of Artificial Sequence:  Synthetic Peptide
APHVLVNPV

SEQ ID NO: 5934 - protein, 9 aa, Artificial Sequence
  Description of Artificial Sequence:  Synthetic Peptide
APRGGLVLF

SEQ ID NO: 5935 - protein, 9 aa, Artificial Sequence
  Description of Artificial Sequence:  Synthetic Peptide
APRGGLVLF

SEQ ID NO: 5936 - protein, 9 aa, Artificial Sequence
  Description of Artificial Sequence:  Synthetic Peptide
FSRKTSVSL

SEQ ID NO: 5937 - protein, 10 aa, Artificial Sequence
  Description of Artificial Sequence:  Synthetic Peptide
LVLFSRKTSV

SEQ ID NO: 5938 - protein, 10 aa, Artificial Sequence
  Description of Artificial Sequence:  Synthetic Peptide
LVNPVPFIQV

SEQ ID NO: 5939 - protein, 10 aa, Artificial Sequence
  Description of Artificial Sequence:  Synthetic Peptide
LFSRKTSVSL

SEQ ID NO: 5940 - protein, 10 aa, Artificial Sequence
  Description of Artificial Sequence:  Synthetic Peptide
QPNQAPRGGL

SEQ ID NO: 5941 - protein, 10 aa, Artificial Sequence
  Description of Artificial Sequence:  Synthetic Peptide
APRGGLVLFS

SEQ ID NO: 5942 - protein, 10 aa, Artificial Sequence
  Description of Artificial Sequence:  Synthetic Peptide
QPNQAPRGGL

SEQ ID NO: 5943 - protein, 9 aa, Artificial Sequence
  Description of Artificial Sequence:  Synthetic Peptide
GQPELLNLL

SEQ ID NO: 5944 - protein, 9 aa, Artificial Sequence
  Description of Artificial Sequence:  Synthetic Peptide
SYSKVPHPI

SEQ ID NO: 5945 - protein, 9 aa, Artificial Sequence
  Description of Artificial Sequence:  Synthetic Peptide
GQPELLNLL

SEQ ID NO: 5946 - protein, 9 aa, Artificial Sequence
  Description of Artificial Sequence:  Synthetic Peptide
STLVTLVSY

SEQ ID NO: 5947 - protein, 10 aa, Artificial Sequence
  Description of Artificial Sequence:  Synthetic Peptide
LVTLVSYSKV

SEQ ID NO: 5948 - protein, 10 aa, Artificial Sequence
  Description of Artificial Sequence:  Synthetic Peptide
SGQPELLNLL

SEQ ID NO: 5949 - protein, 10 aa, Artificial Sequence
  Description of Artificial Sequence:  Synthetic Peptide
TLVTLVSYSK

SEQ ID NO: 5950 - protein, 10 aa, Artificial Sequence
  Description of Artificial Sequence:  Synthetic Peptide
RSGQPELLNL

SEQ ID NO: 5951 - protein, 10 aa, Artificial Sequence
  Description of Artificial Sequence:  Synthetic Peptide
SSTLVTLVSY

SEQ ID NO: 5952 - protein, 9 aa, Artificial Sequence
  Description of Artificial Sequence:  Synthetic Peptide
KLPTVRPTV

SEQ ID NO: 5953 - protein, 9 aa, Artificial Sequence
  Description of Artificial Sequence:  Synthetic Peptide
KLSLQLRAV

SEQ ID NO: 5954 - protein, 9 aa, Artificial Sequence
  Description of Artificial Sequence:  Synthetic Peptide
FMCQLPLVL

SEQ ID NO: 5955 - protein, 9 aa, Artificial Sequence
  Description of Artificial Sequence:  Synthetic Peptide
LVLINWTFC

SEQ ID NO: 5956 - protein, 9 aa, Artificial Sequence
  Description of Artificial Sequence:  Synthetic Peptide
LINWTFCWA

SEQ ID NO: 5957 - protein, 9 aa, Artificial Sequence
  Description of Artificial Sequence:  Synthetic Peptide
RAVRFMCQL

SEQ ID NO: 5958 - protein, 9 aa, Artificial Sequence
  Description of Artificial Sequence:  Synthetic Peptide
RAVRFMCQL

SEQ ID NO: 5959 - protein, 9 aa, Artificial Sequence
  Description of Artificial Sequence:  Synthetic Peptide
TVRPTVAPV

SEQ ID NO: 5960 - protein, 10 aa, Artificial Sequence
  Description of Artificial Sequence:  Synthetic Peptide
QLPLVLINWT

SEQ ID NO: 5961 - protein, 10 aa, Artificial Sequence
  Description of Artificial Sequence:  Synthetic Peptide
VLINWTFCWA

SEQ ID NO: 5962 - protein, 10 aa, Artificial Sequence
  Description of Artificial Sequence:  Synthetic Peptide
FMCQLPLVLI

SEQ ID NO: 5963 - protein, 10 aa, Artificial Sequence
  Description of Artificial Sequence:  Synthetic Peptide
LQLRAVRFMC

SEQ ID NO: 5964 - protein, 10 aa, Artificial Sequence
  Description of Artificial Sequence:  Synthetic Peptide
SLQLRAVRFM

SEQ ID NO: 5965 - protein, 10 aa, Artificial Sequence
  Description of Artificial Sequence:  Synthetic Peptide
RFMCQLPLVL

SEQ ID NO: 5966 - protein, 10 aa, Artificial Sequence
  Description of Artificial Sequence:  Synthetic Peptide
KPVCKLSLQL

SEQ ID NO: 5967 - protein, 10 aa, Artificial Sequence
  Description of Artificial Sequence:  Synthetic Peptide
KLSLQLRAVR

SEQ ID NO: 5968 - protein, 10 aa, Artificial Sequence
  Description of Artificial Sequence:  Synthetic Peptide
AVRFMCQLPL

SEQ ID NO: 5969 - protein, 10 aa, Artificial Sequence
  Description of Artificial Sequence:  Synthetic Peptide
APSLKRPAKL

SEQ ID NO: 5970 - protein, 10 aa, Artificial Sequence
  Description of Artificial Sequence:  Synthetic Peptide
KPVCKLSLQL

SEQ ID NO: 5971 - protein, 10 aa, Artificial Sequence
  Description of Artificial Sequence:  Synthetic Peptide
APSLKRPAKL

SEQ ID NO: 5972 - protein, 10 aa, Artificial Sequence
  Description of Artificial Sequence:  Synthetic Peptide
KPVCKLSLQL

SEQ ID NO: 5973 - protein, 10 aa, Artificial Sequence
  Description of Artificial Sequence:  Synthetic Peptide
APSLKRPAKL

SEQ ID NO: 5974 - protein, 10 aa, Artificial Sequence
  Description of Artificial Sequence:  Synthetic Peptide
LPLVLINWTF

SEQ ID NO: 5975 - protein, 10 aa, Artificial Sequence
  Description of Artificial Sequence:  Synthetic Peptide
TLAHAPCMEK

SEQ ID NO: 5976 - protein, 10 aa, Artificial Sequence
  Description of Artificial Sequence:  Synthetic Peptide
IMSHAMRWPV

SEQ ID NO: 5977 - protein, 10 aa, Artificial Sequence
  Description of Artificial Sequence:  Synthetic Peptide
MVRVGDQFSI

SEQ ID NO: 5978 - protein, 9 aa, Artificial Sequence
  Description of Artificial Sequence:  Synthetic Peptide
KLWRSGDTI

SEQ ID NO: 5979 - protein, 9 aa, Artificial Sequence
  Description of Artificial Sequence:  Synthetic Peptide
AEQTVAAIT

SEQ ID NO: 5980 - protein, 10 aa, Artificial Sequence
  Description of Artificial Sequence:  Synthetic Peptide
ITAPHTSPTY

SEQ ID NO: 5981 - protein, 10 aa, Artificial Sequence
  Description of Artificial Sequence:  Synthetic Peptide
KLWRSGDTIR

SEQ ID NO: 5982 - protein, 10 aa, Artificial Sequence
  Description of Artificial Sequence:  Synthetic Peptide
QLHSWVKLWR

SEQ ID NO: 5983 - protein, 10 aa, Artificial Sequence
  Description of Artificial Sequence:  Synthetic Peptide
AEQTVAAITI

SEQ ID NO: 5984 - protein, 10 aa, Artificial Sequence
  Description of Artificial Sequence:  Synthetic Peptide
ITAPHTSPTY

SEQ ID NO: 5985 - protein, 10 aa, Artificial Sequence
  Description of Artificial Sequence:  Synthetic Peptide
ITAPHTSPTY

SEQ ID NO: 5986 - protein, 9 aa, Artificial Sequence
  Description of Artificial Sequence:  Synthetic Peptide
MLLFEQSLV

SEQ ID NO: 5987 - protein, 9 aa, Artificial Sequence
  Description of Artificial Sequence:  Synthetic Peptide
LLFEQSLVA

SEQ ID NO: 5988 - protein, 9 aa, Artificial Sequence
  Description of Artificial Sequence:  Synthetic Peptide
KEQPGKFLV

SEQ ID NO: 5989 - protein, 9 aa, Artificial Sequence
  Description of Artificial Sequence:  Synthetic Peptide
IEKEQPGKF

SEQ ID NO: 5990 - protein, 9 aa, Artificial Sequence
  Description of Artificial Sequence:  Synthetic Peptide
KEQPGKFLV

SEQ ID NO: 5991 - protein, 10 aa, Artificial Sequence
  Description of Artificial Sequence:  Synthetic Peptide
FLISTEDTGT

SEQ ID NO: 5992 - protein, 10 aa, Artificial Sequence
  Description of Artificial Sequence:  Synthetic Peptide
KEQPGKFLVA

SEQ ID NO: 5993 - protein, 9 aa, Artificial Sequence
  Description of Artificial Sequence:  Synthetic Peptide
RSEVFLVAR

SEQ ID NO: 5994 - protein, 9 aa, Artificial Sequence
  Description of Artificial Sequence:  Synthetic Peptide
FLVARTPNL

SEQ ID NO: 5995 - protein, 9 aa, Artificial Sequence
  Description of Artificial Sequence:  Synthetic Peptide
GYPGFPQDL

SEQ ID NO: 5996 - protein, 9 aa, Artificial Sequence
  Description of Artificial Sequence:  Synthetic Peptide
VMVSMTLPK

SEQ ID NO: 5997 - protein, 9 aa, Artificial Sequence
  Description of Artificial Sequence:  Synthetic Peptide
MVSMTLPKL

SEQ ID NO: 5998 - protein, 9 aa, Artificial Sequence
  Description of Artificial Sequence:  Synthetic Peptide
QPAQPQPSF

SEQ ID NO: 5999 - protein, 9 aa, Artificial Sequence
  Description of Artificial Sequence:  Synthetic Peptide
RSFGMGWRL

SEQ ID NO: 6000 - protein, 9 aa, Artificial Sequence
  Description of Artificial Sequence:  Synthetic Peptide
SEVFLVART

SEQ ID NO: 6001 - protein, 10 aa, Artificial Sequence
  Description of Artificial Sequence:  Synthetic Peptide
VMVSMTLPKL

SEQ ID NO: 6002 - protein, 10 aa, Artificial Sequence
  Description of Artificial Sequence:  Synthetic Peptide
RGWDRSEVFL

SEQ ID NO: 6003 - protein, 10 aa, Artificial Sequence
  Description of Artificial Sequence:  Synthetic Peptide
VFLVARTPNL

SEQ ID NO: 6004 - protein, 10 aa, Artificial Sequence
  Description of Artificial Sequence:  Synthetic Peptide
KPHVMVSMTL

SEQ ID NO: 6005 - protein, 10 aa, Artificial Sequence
  Description of Artificial Sequence:  Synthetic Peptide
PYRGQGYPGF

SEQ ID NO: 6006 - protein, 10 aa, Artificial Sequence
  Description of Artificial Sequence:  Synthetic Peptide
VARTPNLGPL

SEQ ID NO: 6007 - protein, 10 aa, Artificial Sequence
  Description of Artificial Sequence:  Synthetic Peptide
KPHVMVSMTL

SEQ ID NO: 6008 - protein, 10 aa, Artificial Sequence
  Description of Artificial Sequence:  Synthetic Peptide
KLRDLCRGSL

SEQ ID NO: 6009 - protein, 10 aa, Artificial Sequence
  Description of Artificial Sequence:  Synthetic Peptide
LPRGWDRSEV

SEQ ID NO: 6010 - protein, 10 aa, Artificial Sequence
  Description of Artificial Sequence:  Synthetic Peptide
DPRGDRSQPA

SEQ ID NO: 6011 - protein, 10 aa, Artificial Sequence
  Description of Artificial Sequence:  Synthetic Peptide
LPVERRSFGM

SEQ ID NO: 6012 - protein, 10 aa, Artificial Sequence
  Description of Artificial Sequence:  Synthetic Peptide
YPMRSAKPHV

SEQ ID NO: 6013 - protein, 10 aa, Artificial Sequence
  Description of Artificial Sequence:  Synthetic Peptide
DPRGDRSQPA

SEQ ID NO: 6014 - protein, 10 aa, Artificial Sequence
  Description of Artificial Sequence:  Synthetic Peptide
VARTPNLGPL

SEQ ID NO: 6015 - protein, 10 aa, Artificial Sequence
  Description of Artificial Sequence:  Synthetic Peptide
LPVERRSFGM

SEQ ID NO: 6016 - protein, 10 aa, Artificial Sequence
  Description of Artificial Sequence:  Synthetic Peptide
KPHVMVSMTL

SEQ ID NO: 6017 - protein, 10 aa, Artificial Sequence
  Description of Artificial Sequence:  Synthetic Peptide
LPRGWDRSEV

SEQ ID NO: 6018 - protein, 10 aa, Artificial Sequence
  Description of Artificial Sequence:  Synthetic Peptide
SAKPHVMVSM

SEQ ID NO: 6019 - protein, 10 aa, Artificial Sequence
  Description of Artificial Sequence:  Synthetic Peptide
KLRDLCRGSL

SEQ ID NO: 6020 - protein, 10 aa, Artificial Sequence
  Description of Artificial Sequence:  Synthetic Peptide
QDLPVERRSF

SEQ ID NO: 6021 - protein, 10 aa, Artificial Sequence
  Description of Artificial Sequence:  Synthetic Peptide
VERRSFGMGW

SEQ ID NO: 6022 - protein, 9 aa, Artificial Sequence
  Description of Artificial Sequence:  Synthetic Peptide
VLPHGPDVV

SEQ ID NO: 6023 - protein, 9 aa, Artificial Sequence
  Description of Artificial Sequence:  Synthetic Peptide
LLLLGPTWC

SEQ ID NO: 6024 - protein, 9 aa, Artificial Sequence
  Description of Artificial Sequence:  Synthetic Peptide
LLLGPTWCY

SEQ ID NO: 6025 - protein, 9 aa, Artificial Sequence
  Description of Artificial Sequence:  Synthetic Peptide
TQRADWQLL

SEQ ID NO: 6026 - protein, 10 aa, Artificial Sequence
  Description of Artificial Sequence:  Synthetic Peptide
QLLLLGPTWC

SEQ ID NO: 6027 - protein, 10 aa, Artificial Sequence
  Description of Artificial Sequence:  Synthetic Peptide
WCYEGSCPGV

SEQ ID NO: 6028 - protein, 10 aa, Artificial Sequence
  Description of Artificial Sequence:  Synthetic Peptide
RVTQRADWQL

SEQ ID NO: 6029 - protein, 10 aa, Artificial Sequence
  Description of Artificial Sequence:  Synthetic Peptide
LLLLGPTWCY

SEQ ID NO: 6030 - protein, 10 aa, Artificial Sequence
  Description of Artificial Sequence:  Synthetic Peptide
TQRADWQLLL

SEQ ID NO: 6031 - protein, 10 aa, Artificial Sequence
  Description of Artificial Sequence:  Synthetic Peptide
RVTQRADWQL

SEQ ID NO: 6032 - protein, 9 aa, Artificial Sequence
  Description of Artificial Sequence:  Synthetic Peptide
HPLDRPLSL

SEQ ID NO: 6033 - protein, 9 aa, Artificial Sequence
  Description of Artificial Sequence:  Synthetic Peptide
SVHPLDRPL

SEQ ID NO: 6034 - protein, 9 aa, Artificial Sequence
  Description of Artificial Sequence:  Synthetic Peptide
HPLDRPLSL

SEQ ID NO: 6035 - protein, 9 aa, Artificial Sequence
  Description of Artificial Sequence:  Synthetic Peptide
HPLDRPLSL

SEQ ID NO: 6036 - protein, 10 aa, Artificial Sequence
  Description of Artificial Sequence:  Synthetic Peptide
SLADVAAQDC

SEQ ID NO: 6037 - protein, 10 aa, Artificial Sequence
  Description of Artificial Sequence:  Synthetic Peptide
SPRGKGDQSV

SEQ ID NO: 6038 - protein, 10 aa, Artificial Sequence
  Description of Artificial Sequence:  Synthetic Peptide
SPRGKGDQSV

SEQ ID NO: 6039 - protein, 10 aa, Artificial Sequence
  Description of Artificial Sequence:  Synthetic Peptide
QDCCANDSHY

SEQ ID NO: 6040 - protein, 9 aa, Artificial Sequence
  Description of Artificial Sequence:  Synthetic Peptide
LVGHGTQAV

SEQ ID NO: 6041 - protein, 10 aa, Artificial Sequence
  Description of Artificial Sequence:  Synthetic Peptide
NLVGHGTQAV

SEQ ID NO: 6042 - protein, 9 aa, Artificial Sequence
  Description of Artificial Sequence:  Synthetic Peptide
CLSPPHDDL

SEQ ID NO: 6043 - protein, 9 aa, Artificial Sequence
  Description of Artificial Sequence:  Synthetic Peptide
SPPHDDLLL

SEQ ID NO: 6044 - protein, 9 aa, Artificial Sequence
  Description of Artificial Sequence:  Synthetic Peptide
GNRQVPQTL

SEQ ID NO: 6045 - protein, 9 aa, Artificial Sequence
  Description of Artificial Sequence:  Synthetic Peptide
SPPHDDLLL

SEQ ID NO: 6046 - protein, 10 aa, Artificial Sequence
  Description of Artificial Sequence:  Synthetic Peptide
LLHWAEHDRL

SEQ ID NO: 6047 - protein, 10 aa, Artificial Sequence
  Description of Artificial Sequence:  Synthetic Peptide
CLSPPHDDLL

SEQ ID NO: 6048 - protein, 10 aa, Artificial Sequence
  Description of Artificial Sequence:  Synthetic Peptide
HGNRQVPQTL

SEQ ID NO: 6049 - protein, 9 aa, Artificial Sequence
  Description of Artificial Sequence:  Synthetic Peptide
TLNIGSIWV

SEQ ID NO: 6050 - protein, 9 aa, Artificial Sequence
  Description of Artificial Sequence:  Synthetic Peptide
WIMPQSVRV

SEQ ID NO: 6051 - protein, 9 aa, Artificial Sequence
  Description of Artificial Sequence:  Synthetic Peptide
SIWVLPKTV

SEQ ID NO: 6052 - protein, 9 aa, Artificial Sequence
  Description of Artificial Sequence:  Synthetic Peptide
VLPKTVCRA

SEQ ID NO: 6053 - protein, 9 aa, Artificial Sequence
  Description of Artificial Sequence:  Synthetic Peptide
IMPQSVRVV

SEQ ID NO: 6054 - protein, 9 aa, Artificial Sequence
  Description of Artificial Sequence:  Synthetic Peptide
HPPYIHPHL

SEQ ID NO: 6055 - protein, 9 aa, Artificial Sequence
  Description of Artificial Sequence:  Synthetic Peptide
MPQSVRVVY

SEQ ID NO: 6056 - protein, 9 aa, Artificial Sequence
  Description of Artificial Sequence:  Synthetic Peptide
HPPYIHPHL

SEQ ID NO: 6057 - protein, 9 aa, Artificial Sequence
  Description of Artificial Sequence:  Synthetic Peptide
HPHLEDGEI

SEQ ID NO: 6058 - protein, 9 aa, Artificial Sequence
  Description of Artificial Sequence:  Synthetic Peptide
GEIYGAWIM

SEQ ID NO: 6059 - protein, 10 aa, Artificial Sequence
  Description of Artificial Sequence:  Synthetic Peptide
TLNIGSIWVL

SEQ ID NO: 6060 - protein, 10 aa, Artificial Sequence
  Description of Artificial Sequence:  Synthetic Peptide
WIMPQSVRVV

SEQ ID NO: 6061 - protein, 10 aa, Artificial Sequence
  Description of Artificial Sequence:  Synthetic Peptide
STLNIGSIWV

SEQ ID NO: 6062 - protein, 10 aa, Artificial Sequence
  Description of Artificial Sequence:  Synthetic Peptide
WVLPKTVCRA

SEQ ID NO: 6063 - protein, 10 aa, Artificial Sequence
  Description of Artificial Sequence:  Synthetic Peptide
NIGSIWVLPK

SEQ ID NO: 6064 - protein, 10 aa, Artificial Sequence
  Description of Artificial Sequence:  Synthetic Peptide
HPHLEDGEIY

SEQ ID NO: 6065 - protein, 10 aa, Artificial Sequence
  Description of Artificial Sequence:  Synthetic Peptide
LEDGEIYGAW

SEQ ID NO: 6066 - protein, 9 aa, Artificial Sequence
  Description of Artificial Sequence:  Synthetic Peptide
KQGGHETRV

SEQ ID NO: 6067 - protein, 9 aa, Artificial Sequence
  Description of Artificial Sequence:  Synthetic Peptide
VYVPAAVGI

SEQ ID NO: 6068 - protein, 9 aa, Artificial Sequence
  Description of Artificial Sequence:  Synthetic Peptide
VFNIGDVGL

SEQ ID NO: 6069 - protein, 9 aa, Artificial Sequence
  Description of Artificial Sequence:  Synthetic Peptide
QPTAGRQTL

SEQ ID NO: 6070 - protein, 9 aa, Artificial Sequence
  Description of Artificial Sequence:  Synthetic Peptide
AVRPHVFNI

SEQ ID NO: 6071 - protein, 9 aa, Artificial Sequence
  Description of Artificial Sequence:  Synthetic Peptide
MPAVRPHVF

SEQ ID NO: 6072 - protein, 9 aa, Artificial Sequence
  Description of Artificial Sequence:  Synthetic Peptide
QPTAGRQTL

SEQ ID NO: 6073 - protein, 9 aa, Artificial Sequence
  Description of Artificial Sequence:  Synthetic Peptide
IAVEGGPVY

SEQ ID NO: 6074 - protein, 10 aa, Artificial Sequence
  Description of Artificial Sequence:  Synthetic Peptide
IAVEGGPVYV

SEQ ID NO: 6075 - protein, 10 aa, Artificial Sequence
  Description of Artificial Sequence:  Synthetic Peptide
AARAVEFVGI

SEQ ID NO: 6076 - protein, 10 aa, Artificial Sequence
  Description of Artificial Sequence:  Synthetic Peptide
HVFNIGDVGL

SEQ ID NO: 6077 - protein, 10 aa, Artificial Sequence
  Description of Artificial Sequence:  Synthetic Peptide
FNIGDVGLVF

SEQ ID NO: 6078 - protein, 10 aa, Artificial Sequence
  Description of Artificial Sequence:  Synthetic Peptide
AAEDNFQDQL

SEQ ID NO: 6079 - protein, 9 aa, Artificial Sequence
  Description of Artificial Sequence:  Synthetic Peptide
VSECTAVFY

SEQ ID NO: 6080 - protein, 9 aa, Artificial Sequence
  Description of Artificial Sequence:  Synthetic Peptide
YLYPAAQGT

SEQ ID NO: 6081 - protein, 9 aa, Artificial Sequence
  Description of Artificial Sequence:  Synthetic Peptide
TLVDGTVAL

SEQ ID NO: 6082 - protein, 9 aa, Artificial Sequence
  Description of Artificial Sequence:  Synthetic Peptide
FYSHIRCYL

SEQ ID NO: 6083 - protein, 9 aa, Artificial Sequence
  Description of Artificial Sequence:  Synthetic Peptide
LYPAAQGTI

SEQ ID NO: 6084 - protein, 9 aa, Artificial Sequence
  Description of Artificial Sequence:  Synthetic Peptide
AFWRYYKSL

SEQ ID NO: 6085 - protein, 9 aa, Artificial Sequence
  Description of Artificial Sequence:  Synthetic Peptide
KMENCVSEL

SEQ ID NO: 6086 - protein, 9 aa, Artificial Sequence
  Description of Artificial Sequence:  Synthetic Peptide
ILAWDTSRK

SEQ ID NO: 6087 - protein, 9 aa, Artificial Sequence
  Description of Artificial Sequence:  Synthetic Peptide
VVAFWRYYK

SEQ ID NO: 6088 - protein, 9 aa, Artificial Sequence
  Description of Artificial Sequence:  Synthetic Peptide
ALLGKVVAF

SEQ ID NO: 6089 - protein, 9 aa, Artificial Sequence
  Description of Artificial Sequence:  Synthetic Peptide
AAQGTIVIL

SEQ ID NO: 6090 - protein, 9 aa, Artificial Sequence
  Description of Artificial Sequence:  Synthetic Peptide
VVRAIISGV

SEQ ID NO: 6091 - protein, 9 aa, Artificial Sequence
  Description of Artificial Sequence:  Synthetic Peptide
LAWDTSRKM

SEQ ID NO: 6092 - protein, 9 aa, Artificial Sequence
  Description of Artificial Sequence:  Synthetic Peptide
YSHIRCYLY

SEQ ID NO: 6093 - protein, 9 aa, Artificial Sequence
  Description of Artificial Sequence:  Synthetic Peptide
SECTAVFYS

SEQ ID NO: 6094 - protein, 9 aa, Artificial Sequence
  Description of Artificial Sequence:  Synthetic Peptide
SELPGDAVV

SEQ ID NO: 6095 - protein, 10 aa, Artificial Sequence
  Description of Artificial Sequence:  Synthetic Peptide
TLVDGTVALL

SEQ ID NO: 6096 - protein, 10 aa, Artificial Sequence
  Description of Artificial Sequence:  Synthetic Peptide
YLYPAAQGTI

SEQ ID NO: 6097 - protein, 10 aa, Artificial Sequence
  Description of Artificial Sequence:  Synthetic Peptide
AVVRAIISGV

SEQ ID NO: 6098 - protein, 10 aa, Artificial Sequence
  Description of Artificial Sequence:  Synthetic Peptide
CVSELPGDAV

SEQ ID NO: 6099 - protein, 10 aa, Artificial Sequence
  Description of Artificial Sequence:  Synthetic Peptide
VFYSHIRCYL

SEQ ID NO: 6100 - protein, 10 aa, Artificial Sequence
  Description of Artificial Sequence:  Synthetic Peptide
KVVAFWRYYK

SEQ ID NO: 6101 - protein, 10 aa, Artificial Sequence
  Description of Artificial Sequence:  Synthetic Peptide
LLGKVVAFWR

SEQ ID NO: 6102 - protein, 10 aa, Artificial Sequence
  Description of Artificial Sequence:  Synthetic Peptide
VAFWRYYKSL

SEQ ID NO: 6103 - protein, 10 aa, Artificial Sequence
  Description of Artificial Sequence:  Synthetic Peptide
VVRAIISGVV

SEQ ID NO: 6104 - protein, 10 aa, Artificial Sequence
  Description of Artificial Sequence:  Synthetic Peptide
QSRADRSCHY

SEQ ID NO: 6105 - protein, 10 aa, Artificial Sequence
  Description of Artificial Sequence:  Synthetic Peptide
LPGDAVVRAI

SEQ ID NO: 6106 - protein, 9 aa, Artificial Sequence
  Description of Artificial Sequence:  Synthetic Peptide
RELDVLWAA

SEQ ID NO: 6107 - protein, 9 aa, Artificial Sequence
  Description of Artificial Sequence:  Synthetic Peptide
EPTCPTATL

SEQ ID NO: 6108 - protein, 9 aa, Artificial Sequence
  Description of Artificial Sequence:  Synthetic Peptide
IQRPRISWL

SEQ ID NO: 6109 - protein, 9 aa, Artificial Sequence
  Description of Artificial Sequence:  Synthetic Peptide
TQRYSASSL

SEQ ID NO: 6110 - protein, 9 aa, Artificial Sequence
  Description of Artificial Sequence:  Synthetic Peptide
AATRELDVL

SEQ ID NO: 6111 - protein, 9 aa, Artificial Sequence
  Description of Artificial Sequence:  Synthetic Peptide
GAPIFRDGL

SEQ ID NO: 6112 - protein, 9 aa, Artificial Sequence
  Description of Artificial Sequence:  Synthetic Peptide
ASPTRLGSL

SEQ ID NO: 6113 - protein, 9 aa, Artificial Sequence
  Description of Artificial Sequence:  Synthetic Peptide
IQRPRISWL

SEQ ID NO: 6114 - protein, 9 aa, Artificial Sequence
  Description of Artificial Sequence:  Synthetic Peptide
EPTCPTATL

SEQ ID NO: 6115 - protein, 9 aa, Artificial Sequence
  Description of Artificial Sequence:  Synthetic Peptide
RSTRPPGAL

SEQ ID NO: 6116 - protein, 9 aa, Artificial Sequence
  Description of Artificial Sequence:  Synthetic Peptide
RELDVLWAA

SEQ ID NO: 6117 - protein, 10 aa, Artificial Sequence
  Description of Artificial Sequence:  Synthetic Peptide
AVCVSFGFSL

SEQ ID NO: 6118 - protein, 10 aa, Artificial Sequence
  Description of Artificial Sequence:  Synthetic Peptide
SIQRPRISWL

SEQ ID NO: 6119 - protein, 10 aa, Artificial Sequence
  Description of Artificial Sequence:  Synthetic Peptide
RELDVLWAAV

SEQ ID NO: 6120 - protein, 10 aa, Artificial Sequence
  Description of Artificial Sequence:  Synthetic Peptide
TLVSIQRPRI

SEQ ID NO: 6121 - protein, 10 aa, Artificial Sequence
  Description of Artificial Sequence:  Synthetic Peptide
RQQVNSANDL

SEQ ID NO: 6122 - protein, 10 aa, Artificial Sequence
  Description of Artificial Sequence:  Synthetic Peptide
RPPGALASTL

SEQ ID NO: 6123 - protein, 10 aa, Artificial Sequence
  Description of Artificial Sequence:  Synthetic Peptide
RYSASSLAGA

SEQ ID NO: 6124 - protein, 10 aa, Artificial Sequence
  Description of Artificial Sequence:  Synthetic Peptide
GLAGGAPIFR

SEQ ID NO: 6125 - protein, 10 aa, Artificial Sequence
  Description of Artificial Sequence:  Synthetic Peptide
VLWAAVCVSF

SEQ ID NO: 6126 - protein, 10 aa, Artificial Sequence
  Description of Artificial Sequence:  Synthetic Peptide
LASPTRLGSL

SEQ ID NO: 6127 - protein, 10 aa, Artificial Sequence
  Description of Artificial Sequence:  Synthetic Peptide
GARSTRPPGA

SEQ ID NO: 6128 - protein, 10 aa, Artificial Sequence
  Description of Artificial Sequence:  Synthetic Peptide
RPPGALASTL

SEQ ID NO: 6129 - protein, 10 aa, Artificial Sequence
  Description of Artificial Sequence:  Synthetic Peptide
TTRPFATQRY

SEQ ID NO: 6130 - protein, 9 aa, Artificial Sequence
  Description of Artificial Sequence:  Synthetic Peptide
ALVRVSCSL

SEQ ID NO: 6131 - protein, 9 aa, Artificial Sequence
  Description of Artificial Sequence:  Synthetic Peptide
ALVRVSCSL

SEQ ID NO: 6132 - protein, 10 aa, Artificial Sequence
  Description of Artificial Sequence:  Synthetic Peptide
MALVRVSCSL

SEQ ID NO: 6133 - protein, 10 aa, Artificial Sequence
  Description of Artificial Sequence:  Synthetic Peptide
AIWVKSSIPL

SEQ ID NO: 6134 - protein, 9 aa, Artificial Sequence
  Description of Artificial Sequence:  Synthetic Peptide
CPRAAPVHL

SEQ ID NO: 6135 - protein, 9 aa, Artificial Sequence
  Description of Artificial Sequence:  Synthetic Peptide
APVHLGAQM

SEQ ID NO: 6136 - protein, 10 aa, Artificial Sequence
  Description of Artificial Sequence:  Synthetic Peptide
AIWVKSSIPL

SEQ ID NO: 6137 - protein, 9 aa, Artificial Sequence
  Description of Artificial Sequence:  Synthetic Peptide
CPRAAPVHL

SEQ ID NO: 6138 - protein, 9 aa, Artificial Sequence
  Description of Artificial Sequence:  Synthetic Peptide
CPRAAPVHL

SEQ ID NO: 6139 - protein, 9 aa, Artificial Sequence
  Description of Artificial Sequence:  Synthetic Peptide
APVHLGAQM

SEQ ID NO: 6140 - protein, 9 aa, Artificial Sequence
  Description of Artificial Sequence:  Synthetic Peptide
TPGGGPAIW

SEQ ID NO: 6141 - protein, 10 aa, Artificial Sequence
  Description of Artificial Sequence:  Synthetic Peptide
CTHPAAYLVF

SEQ ID NO: 6142 - protein, 9 aa, Artificial Sequence
  Description of Artificial Sequence:  Synthetic Peptide
AYLVFRTTI

SEQ ID NO: 6143 - protein, 10 aa, Artificial Sequence
  Description of Artificial Sequence:  Synthetic Peptide
SFCTHPAAYL

SEQ ID NO: 6144 - protein, 10 aa, Artificial Sequence
  Description of Artificial Sequence:  Synthetic Peptide
TSFCTHPAAY

SEQ ID NO: 6145 - protein, 10 aa, Artificial Sequence
  Description of Artificial Sequence:  Synthetic Peptide
MPPEGLLAFL

SEQ ID NO: 6146 - protein, 9 aa, Artificial Sequence
  Description of Artificial Sequence:  Synthetic Peptide
APNRNCSWL

SEQ ID NO: 6147 - protein, 9 aa, Artificial Sequence
  Description of Artificial Sequence:  Synthetic Peptide
MARGTSTAL

SEQ ID NO: 6148 - protein, 10 aa, Artificial Sequence
  Description of Artificial Sequence:  Synthetic Peptide
MPPEGLLAFL

SEQ ID NO: 6149 - protein, 10 aa, Artificial Sequence
  Description of Artificial Sequence:  Synthetic Peptide
WAPNRNCSWL

SEQ ID NO: 6150 - protein, 9 aa, Artificial Sequence
  Description of Artificial Sequence:  Synthetic Peptide
MARGTSTAL

SEQ ID NO: 6151 - protein, 9 aa, Artificial Sequence
  Description of Artificial Sequence:  Synthetic Peptide
MPPEGLLAF

SEQ ID NO: 6152 - protein, 9 aa, Artificial Sequence
  Description of Artificial Sequence:  Synthetic Peptide
APNRNCSWL

SEQ ID NO: 6153 - protein, 10 aa, Artificial Sequence
  Description of Artificial Sequence:  Synthetic Peptide
MPPEGLLAFL

SEQ ID NO: 6154 - protein, 9 aa, Artificial Sequence
  Description of Artificial Sequence:  Synthetic Peptide
GLLAFLVWA

SEQ ID NO: 6155 - protein, 10 aa, Artificial Sequence
  Description of Artificial Sequence:  Synthetic Peptide
MPPEGLLAFL

SEQ ID NO: 6156 - protein, 9 aa, Artificial Sequence
  Description of Artificial Sequence:  Synthetic Peptide
VLYTASHHR

SEQ ID NO: 6157 - protein, 9 aa, Artificial Sequence
  Description of Artificial Sequence:  Synthetic Peptide
HLDLVKLSR

SEQ ID NO: 6158 - protein, 9 aa, Artificial Sequence
  Description of Artificial Sequence:  Synthetic Peptide
TAGTTHLDL

SEQ ID NO: 6159 - protein, 10 aa, Artificial Sequence
  Description of Artificial Sequence:  Synthetic Peptide
LSRHQVSAVL

SEQ ID NO: 6160 - protein, 10 aa, Artificial Sequence
  Description of Artificial Sequence:  Synthetic Peptide
TNRTAGTTHL

SEQ ID NO: 6161 - protein, 10 aa, Artificial Sequence
  Description of Artificial Sequence:  Synthetic Peptide
LSRHQVSAVL

SEQ ID NO: 6162 - protein, 9 aa, Artificial Sequence
  Description of Artificial Sequence:  Synthetic Peptide
CGLPVVGGL

SEQ ID NO: 6163 - protein, 9 aa, Artificial Sequence
  Description of Artificial Sequence:  Synthetic Peptide
TPGVRMIPM

SEQ ID NO: 6164 - protein, 9 aa, Artificial Sequence
  Description of Artificial Sequence:  Synthetic Peptide
TPGVRMIPM

SEQ ID NO: 6165 - protein, 10 aa, Artificial Sequence
  Description of Artificial Sequence:  Synthetic Peptide
NILRPHTAGV

SEQ ID NO: 6166 - protein, 9 aa, Artificial Sequence
  Description of Artificial Sequence:  Synthetic Peptide
APPTASGNI

SEQ ID NO: 6167 - protein, 10 aa, Artificial Sequence
  Description of Artificial Sequence:  Synthetic Peptide
APPTASGNIL

SEQ ID NO: 6168 - protein, 10 aa, Artificial Sequence
  Description of Artificial Sequence:  Synthetic Peptide
APPTASGNIL

SEQ ID NO: 6169 - protein, 10 aa, Artificial Sequence
  Description of Artificial Sequence:  Synthetic Peptide
ALDLAWWDGR

SEQ ID NO: 6170 - protein, 9 aa, Artificial Sequence
  Description of Artificial Sequence:  Synthetic Peptide
YVDASPPSK

SEQ ID NO: 6171 - protein, 9 aa, Artificial Sequence
  Description of Artificial Sequence:  Synthetic Peptide
YLHAGVGTV

SEQ ID NO: 6172 - protein, 9 aa, Artificial Sequence
  Description of Artificial Sequence:  Synthetic Peptide
YGGTSTPYV

SEQ ID NO: 6173 - protein, 10 aa, Artificial Sequence
  Description of Artificial Sequence:  Synthetic Peptide
SLPYHPGTSI

SEQ ID NO: 6174 - protein, 10 aa, Artificial Sequence
  Description of Artificial Sequence:  Synthetic Peptide
ALYGGTSTPY

SEQ ID NO: 6175 - protein, 9 aa, Artificial Sequence
  Description of Artificial Sequence:  Synthetic Peptide
RGRVKTALL

SEQ ID NO: 6176 - protein, 9 aa, Artificial Sequence
  Description of Artificial Sequence:  Synthetic Peptide
LPYHPGTSI

SEQ ID NO: 6177 - protein, 10 aa, Artificial Sequence
  Description of Artificial Sequence:  Synthetic Peptide
RVKTALLSAL

SEQ ID NO: 6178 - protein, 9 aa, Artificial Sequence
  Description of Artificial Sequence:  Synthetic Peptide
WPSSASLPY

SEQ ID NO: 6179 - protein, 9 aa, Artificial Sequence
  Description of Artificial Sequence:  Synthetic Peptide
TSIGSAALY

SEQ ID NO: 6180 - protein, 9 aa, Artificial Sequence
  Description of Artificial Sequence:  Synthetic Peptide
TSIGSAALY

SEQ ID NO: 6181 - protein, 9 aa, Artificial Sequence
  Description of Artificial Sequence:  Synthetic Peptide
KLGAFLGLL

SEQ ID NO: 6182 - protein, 9 aa, Artificial Sequence
  Description of Artificial Sequence:  Synthetic Peptide
RSQHTPSKL

SEQ ID NO: 6183 - protein, 9 aa, Artificial Sequence
  Description of Artificial Sequence:  Synthetic Peptide
TPSKLGAFL

SEQ ID NO: 6184 - protein, 9 aa, Artificial Sequence
  Description of Artificial Sequence:  Synthetic Peptide
TPSKLGAFL

SEQ ID NO: 6185 - protein, 9 aa, Artificial Sequence
  Description of Artificial Sequence:  Synthetic Peptide
RSQHTPSKL

SEQ ID NO: 6186 - protein, 9 aa, Artificial Sequence
  Description of Artificial Sequence:  Synthetic Peptide
IPRSKCTQM

SEQ ID NO: 6187 - protein, 9 aa, Artificial Sequence
  Description of Artificial Sequence:  Synthetic Peptide
APNIPRSKC

SEQ ID NO: 6188 - protein, 9 aa, Artificial Sequence
  Description of Artificial Sequence:  Synthetic Peptide
IPRSKCTQM

SEQ ID NO: 6189 - protein, 9 aa, Artificial Sequence
  Description of Artificial Sequence:  Synthetic Peptide
IPRSKCTQM

SEQ ID NO: 6190 - protein, 9 aa, Artificial Sequence
  Description of Artificial Sequence:  Synthetic Peptide
VLDLSPVSK

SEQ ID NO: 6191 - protein, 10 aa, Artificial Sequence
  Description of Artificial Sequence:  Synthetic Peptide
RGMLQGSLGL

SEQ ID NO: 6192 - protein, 9 aa, Artificial Sequence
  Description of Artificial Sequence:  Synthetic Peptide
VLDLSPVSK

SEQ ID NO: 6193 - protein, 9 aa, Artificial Sequence
  Description of Artificial Sequence:  Synthetic Peptide
TPQRACSVL

SEQ ID NO: 6194 - protein, 10 aa, Artificial Sequence
  Description of Artificial Sequence:  Synthetic Peptide
ALRGMLQGSL

SEQ ID NO: 6195 - protein, 10 aa, Artificial Sequence
  Description of Artificial Sequence:  Synthetic Peptide
VPLEVLLCAL

SEQ ID NO: 6196 - protein, 10 aa, Artificial Sequence
  Description of Artificial Sequence:  Synthetic Peptide
RGMLQGSLGL

SEQ ID NO: 6197 - protein, 9 aa, Artificial Sequence
  Description of Artificial Sequence:  Synthetic Peptide
TPQRACSVL

SEQ ID NO: 6198 - protein, 9 aa, Artificial Sequence
  Description of Artificial Sequence:  Synthetic Peptide
VSKVPLEVL

SEQ ID NO: 6199 - protein, 10 aa, Artificial Sequence
  Description of Artificial Sequence:  Synthetic Peptide
VPLEVLLCAL

SEQ ID NO: 6200 - protein, 10 aa, Artificial Sequence
  Description of Artificial Sequence:  Synthetic Peptide
VSKVPLEVLL

SEQ ID NO: 6201 - protein, 10 aa, Artificial Sequence
  Description of Artificial Sequence:  Synthetic Peptide
RPLTWHKDIL

SEQ ID NO: 6202 - protein, 9 aa, Artificial Sequence
  Description of Artificial Sequence:  Synthetic Peptide
MPRPAAVKA

SEQ ID NO: 6203 - protein, 10 aa, Artificial Sequence
  Description of Artificial Sequence:  Synthetic Peptide
RPLTWHKDIL

SEQ ID NO: 6204 - protein, 10 aa, Artificial Sequence
  Description of Artificial Sequence:  Synthetic Peptide
AVKAQRSRPL

SEQ ID NO: 6205 - protein, 10 aa, Artificial Sequence
  Description of Artificial Sequence:  Synthetic Peptide
AVKAQRSRPL

SEQ ID NO: 6206 - protein, 9 aa, Artificial Sequence
  Description of Artificial Sequence:  Synthetic Peptide
RPLTWHKDI

SEQ ID NO: 6207 - protein, 10 aa, Artificial Sequence
  Description of Artificial Sequence:  Synthetic Peptide
RPLTWHKDIL

SEQ ID NO: 6208 - protein, 9 aa, Artificial Sequence
  Description of Artificial Sequence:  Synthetic Peptide
ALGTAPLQL

SEQ ID NO: 6209 - protein, 10 aa, Artificial Sequence
  Description of Artificial Sequence:  Synthetic Peptide
ALGTAPLQLV

SEQ ID NO: 6210 - protein, 9 aa, Artificial Sequence
  Description of Artificial Sequence:  Synthetic Peptide
ALGTAPLQL

SEQ ID NO: 6211 - protein, 10 aa, Artificial Sequence
  Description of Artificial Sequence:  Synthetic Peptide
SALGTAPLQL

SEQ ID NO: 6212 - protein, 10 aa, Artificial Sequence
  Description of Artificial Sequence:  Synthetic Peptide
NVMPKTLLAY

SEQ ID NO: 6213 - protein, 9 aa, Artificial Sequence
  Description of Artificial Sequence:  Synthetic Peptide
TLLAYWVSA

SEQ ID NO: 6214 - protein, 9 aa, Artificial Sequence
  Description of Artificial Sequence:  Synthetic Peptide
LLAYWVSAR

SEQ ID NO: 6215 - protein, 9 aa, Artificial Sequence
  Description of Artificial Sequence:  Synthetic Peptide
VMPKTLLAY

SEQ ID NO: 6216 - protein, 10 aa, Artificial Sequence
  Description of Artificial Sequence:  Synthetic Peptide
TLLAYWVSAR

SEQ ID NO: 6217 - protein, 9 aa, Artificial Sequence
  Description of Artificial Sequence:  Synthetic Peptide
MPKTLLAYW

SEQ ID NO: 6218 - protein, 10 aa, Artificial Sequence
  Description of Artificial Sequence:  Synthetic Peptide
MPKTLLAYWV

SEQ ID NO: 6219 - protein, 9 aa, Artificial Sequence
  Description of Artificial Sequence:  Synthetic Peptide
HTDMSPPVK

SEQ ID NO: 6220 - protein, 9 aa, Artificial Sequence
  Description of Artificial Sequence:  Synthetic Peptide
RLFSVSAMT

SEQ ID NO: 6221 - protein, 9 aa, Artificial Sequence
  Description of Artificial Sequence:  Synthetic Peptide
MSPPVKDRL

SEQ ID NO: 6222 - protein, 10 aa, Artificial Sequence
  Description of Artificial Sequence:  Synthetic Peptide
LECLTRLFSV

SEQ ID NO: 6223 - protein, 10 aa, Artificial Sequence
  Description of Artificial Sequence:  Synthetic Peptide
CLTRLFSVSA

SEQ ID NO: 6224 - protein, 10 aa, Artificial Sequence
  Description of Artificial Sequence:  Synthetic Peptide
RLFSVSAMTR

SEQ ID NO: 6225 - protein, 9 aa, Artificial Sequence
  Description of Artificial Sequence:  Synthetic Peptide
AVRAEVDSV

SEQ ID NO: 6226 - protein, 10 aa, Artificial Sequence
  Description of Artificial Sequence:  Synthetic Peptide
AARGTISSPL

SEQ ID NO: 6227 - protein, 10 aa, Artificial Sequence
  Description of Artificial Sequence:  Synthetic Peptide
LTRLFSVSAM

SEQ ID NO: 6228 - protein, 9 aa, Artificial Sequence
  Description of Artificial Sequence:  Synthetic Peptide
PVKDRLECL

SEQ ID NO: 6229 - protein, 10 aa, Artificial Sequence
  Description of Artificial Sequence:  Synthetic Peptide
AARGTISSPL

SEQ ID NO: 6230 - protein, 10 aa, Artificial Sequence
  Description of Artificial Sequence:  Synthetic Peptide
AEVDSVHTDM

SEQ ID NO: 6231 - protein, 9 aa, Artificial Sequence
  Description of Artificial Sequence:  Synthetic Peptide
RPFYIGWGL

SEQ ID NO: 6232 - protein, 10 aa, Artificial Sequence
  Description of Artificial Sequence:  Synthetic Peptide
FYIGWGLSKM

SEQ ID NO: 6233 - protein, 9 aa, Artificial Sequence
  Description of Artificial Sequence:  Synthetic Peptide
RPFYIGWGL

SEQ ID NO: 6234 - protein, 9 aa, Artificial Sequence
  Description of Artificial Sequence:  Synthetic Peptide
RPFYIGWGL

SEQ ID NO: 6235 - protein, 9 aa, Artificial Sequence
  Description of Artificial Sequence:  Synthetic Peptide
KPPRTSSKL

SEQ ID NO: 6236 - protein, 9 aa, Artificial Sequence
  Description of Artificial Sequence:  Synthetic Peptide
KPPRTSSKL

SEQ ID NO: 6237 - protein, 9 aa, Artificial Sequence
  Description of Artificial Sequence:  Synthetic Peptide
KPPRTSSKL

SEQ ID NO: 6238 - protein, 9 aa, Artificial Sequence
  Description of Artificial Sequence:  Synthetic Peptide
LVSQAPWWL

SEQ ID NO: 6239 - protein, 9 aa, Artificial Sequence
  Description of Artificial Sequence:  Synthetic Peptide
YLRVLSSSV

SEQ ID NO: 6240 - protein, 10 aa, Artificial Sequence
  Description of Artificial Sequence:  Synthetic Peptide
ELVSQAPWWL

SEQ ID NO: 6241 - protein, 10 aa, Artificial Sequence
  Description of Artificial Sequence:  Synthetic Peptide
LVSQAPWWLL

SEQ ID NO: 6242 - protein, 9 aa, Artificial Sequence
  Description of Artificial Sequence:  Synthetic Peptide
YYLRVLSSS

SEQ ID NO: 6243 - protein, 9 aa, Artificial Sequence
  Description of Artificial Sequence:  Synthetic Peptide
CPPYYLRVL

SEQ ID NO: 6244 - protein, 9 aa, Artificial Sequence
  Description of Artificial Sequence:  Synthetic Peptide
LVSQAPWWL

SEQ ID NO: 6245 - protein, 10 aa, Artificial Sequence
  Description of Artificial Sequence:  Synthetic Peptide
LVSQAPWWLL

SEQ ID NO: 6246 - protein, 9 aa, Artificial Sequence
  Description of Artificial Sequence:  Synthetic Peptide
CPPYYLRVL

SEQ ID NO: 6247 - protein, 9 aa, Artificial Sequence
  Description of Artificial Sequence:  Synthetic Peptide
WSTCCPPYY

SEQ ID NO: 6248 - protein, 9 aa, Artificial Sequence
  Description of Artificial Sequence:  Synthetic Peptide
APWWLLRSW

SEQ ID NO: 6249 - protein, 10 aa, Artificial Sequence
  Description of Artificial Sequence:  Synthetic Peptide
RSWEENSPPL

SEQ ID NO: 6250 - protein, 9 aa, Artificial Sequence
  Description of Artificial Sequence:  Synthetic Peptide
MELVSQAPW

SEQ ID NO: 6251 - protein, 10 aa, Artificial Sequence
  Description of Artificial Sequence:  Synthetic Peptide
MELVSQAPWW

SEQ ID NO: 6252 - protein, 10 aa, Artificial Sequence
  Description of Artificial Sequence:  Synthetic Peptide
EENSPPLRTW

SEQ ID NO: 6253 - protein, 9 aa, Artificial Sequence
  Description of Artificial Sequence:  Synthetic Peptide
CPTSSHGSL

SEQ ID NO: 6254 - protein, 10 aa, Artificial Sequence
  Description of Artificial Sequence:  Synthetic Peptide
CPTSSHGSLL

SEQ ID NO: 6255 - protein, 9 aa, Artificial Sequence
  Description of Artificial Sequence:  Synthetic Peptide
CPTSSHGSL

SEQ ID NO: 6256 - protein, 10 aa, Artificial Sequence
  Description of Artificial Sequence:  Synthetic Peptide
CPTSSHGSLL

SEQ ID NO: 6257 - protein, 9 aa, Artificial Sequence
  Description of Artificial Sequence:  Synthetic Peptide
TLARYGAWL

SEQ ID NO: 6258 - protein, 9 aa, Artificial Sequence
  Description of Artificial Sequence:  Synthetic Peptide
LLSSSLKWM

SEQ ID NO: 6259 - protein, 9 aa, Artificial Sequence
  Description of Artificial Sequence:  Synthetic Peptide
SMSTPPDPV

SEQ ID NO: 6260 - protein, 9 aa, Artificial Sequence
  Description of Artificial Sequence:  Synthetic Peptide
WLPTATLKC

SEQ ID NO: 6261 - protein, 9 aa, Artificial Sequence
  Description of Artificial Sequence:  Synthetic Peptide
GLQGRVHVL

SEQ ID NO: 6262 - protein, 10 aa, Artificial Sequence
  Description of Artificial Sequence:  Synthetic Peptide
RLLSSSLKWM

SEQ ID NO: 6263 - protein, 10 aa, Artificial Sequence
  Description of Artificial Sequence:  Synthetic Peptide
WLPTATLKCA

SEQ ID NO: 6264 - protein, 9 aa, Artificial Sequence
  Description of Artificial Sequence:  Synthetic Peptide
KYRLLSSSL

SEQ ID NO: 6265 - protein, 9 aa, Artificial Sequence
  Description of Artificial Sequence:  Synthetic Peptide
RYGAWLPTA

SEQ ID NO: 6266 - protein, 10 aa, Artificial Sequence
  Description of Artificial Sequence:  Synthetic Peptide
KMSSSVRAKY

SEQ ID NO: 6267 - protein, 9 aa, Artificial Sequence
  Description of Artificial Sequence:  Synthetic Peptide
SVRAKYRLL

SEQ ID NO: 6268 - protein, 9 aa, Artificial Sequence
  Description of Artificial Sequence:  Synthetic Peptide
HVLTCGTVL

SEQ ID NO: 6269 - protein, 9 aa, Artificial Sequence
  Description of Artificial Sequence:  Synthetic Peptide
GAWLPTATL

SEQ ID NO: 6270 - protein, 9 aa, Artificial Sequence
  Description of Artificial Sequence:  Synthetic Peptide
SVRAKYRLL

SEQ ID NO: 6271 - protein, 9 aa, Artificial Sequence
  Description of Artificial Sequence:  Synthetic Peptide
MSSSVRAKY

SEQ ID NO: 6272 - protein, 9 aa, Artificial Sequence
  Description of Artificial Sequence:  Synthetic Peptide
AEWGTSIIL

SEQ ID NO: 6273 - protein, 10 aa, Artificial Sequence
  Description of Artificial Sequence:  Synthetic Peptide
WTVPMCPRRY

SEQ ID NO: 6274 - protein, 9 aa, Artificial Sequence
  Description of Artificial Sequence:  Synthetic Peptide
ILQPFLSGL

SEQ ID NO: 6275 - protein, 9 aa, Artificial Sequence
  Description of Artificial Sequence:  Synthetic Peptide
FLSGLGQTT

SEQ ID NO: 6276 - protein, 9 aa, Artificial Sequence
  Description of Artificial Sequence:  Synthetic Peptide
WLQSVSRNL

SEQ ID NO: 6277 - protein, 10 aa, Artificial Sequence
  Description of Artificial Sequence:  Synthetic Peptide
IMYHQLSMDV

SEQ ID NO: 6278 - protein, 10 aa, Artificial Sequence
  Description of Artificial Sequence:  Synthetic Peptide
NLPSILQPFL

SEQ ID NO: 6279 - protein, 10 aa, Artificial Sequence
  Description of Artificial Sequence:  Synthetic Peptide
SILQPFLSGL

SEQ ID NO: 6280 - protein, 10 aa, Artificial Sequence
  Description of Artificial Sequence:  Synthetic Peptide
FLSGLGQTTI

SEQ ID NO: 6281 - protein, 10 aa, Artificial Sequence
  Description of Artificial Sequence:  Synthetic Peptide
GLGQTTILHC

SEQ ID NO: 6282 - protein, 10 aa, Artificial Sequence
  Description of Artificial Sequence:  Synthetic Peptide
RWLQSVSRNL

SEQ ID NO: 6283 - protein, 10 aa, Artificial Sequence
  Description of Artificial Sequence:  Synthetic Peptide
RNLPSILQPF

SEQ ID NO: 6284 - protein, 9 aa, Artificial Sequence
  Description of Artificial Sequence:  Synthetic Peptide
ILHCWTAGK

SEQ ID NO: 6285 - protein, 9 aa, Artificial Sequence
  Description of Artificial Sequence:  Synthetic Peptide
LPSILQPFL

SEQ ID NO: 6286 - protein, 9 aa, Artificial Sequence
  Description of Artificial Sequence:  Synthetic Peptide
VSRNLPSIL

SEQ ID NO: 6287 - protein, 9 aa, Artificial Sequence
  Description of Artificial Sequence:  Synthetic Peptide
KLRIMYHQL

SEQ ID NO: 6288 - protein, 9 aa, Artificial Sequence
  Description of Artificial Sequence:  Synthetic Peptide
VPMCPRRYV

SEQ ID NO: 6289 - protein, 9 aa, Artificial Sequence
  Description of Artificial Sequence:  Synthetic Peptide
DVPYHHGAL

SEQ ID NO: 6290 - protein, 9 aa, Artificial Sequence
  Description of Artificial Sequence:  Synthetic Peptide
GALRRSLLL

SEQ ID NO: 6291 - protein, 10 aa, Artificial Sequence
  Description of Artificial Sequence:  Synthetic Peptide
SVSRNLPSIL

SEQ ID NO: 6292 - protein, 9 aa, Artificial Sequence
  Description of Artificial Sequence:  Synthetic Peptide
GALRRSLLL

SEQ ID NO: 6293 - protein, 9 aa, Artificial Sequence
  Description of Artificial Sequence:  Synthetic Peptide
LPSILQPFL

SEQ ID NO: 6294 - protein, 9 aa, Artificial Sequence
  Description of Artificial Sequence:  Synthetic Peptide
VSRNLPSIL

SEQ ID NO: 6295 - protein, 10 aa, Artificial Sequence
  Description of Artificial Sequence:  Synthetic Peptide
WTVPMCPRRY

SEQ ID NO: 6296 - protein, 10 aa, Artificial Sequence
  Description of Artificial Sequence:  Synthetic Peptide
ALTQLSLNRT

SEQ ID NO: 6297 - protein, 9 aa, Artificial Sequence
  Description of Artificial Sequence:  Synthetic Peptide
RYTNAATLN

SEQ ID NO: 6298 - protein, 10 aa, Artificial Sequence
  Description of Artificial Sequence:  Synthetic Peptide
SLNRTSGWKR

SEQ ID NO: 6299 - protein, 10 aa, Artificial Sequence
  Description of Artificial Sequence:  Synthetic Peptide
TPAALTQLSL

SEQ ID NO: 6300 - protein, 10 aa, Artificial Sequence
  Description of Artificial Sequence:  Synthetic Peptide
TPAALTQLSL

SEQ ID NO: 6301 - protein, 10 aa, Artificial Sequence
  Description of Artificial Sequence:  Synthetic Peptide
ALTQLSLNRT

SEQ ID NO: 6302 - protein, 9 aa, Artificial Sequence
  Description of Artificial Sequence:  Synthetic Peptide
RYTNAATLN

SEQ ID NO: 6303 - protein, 10 aa, Artificial Sequence
  Description of Artificial Sequence:  Synthetic Peptide
SLNRTSGWKR

SEQ ID NO: 6304 - protein, 10 aa, Artificial Sequence
  Description of Artificial Sequence:  Synthetic Peptide
TPAALTQLSL

SEQ ID NO: 6305 - protein, 10 aa, Artificial Sequence
  Description of Artificial Sequence:  Synthetic Peptide
TPAALTQLSL

SEQ ID NO: 6306 - protein, 9 aa, Artificial Sequence
  Description of Artificial Sequence:  Synthetic Peptide
MIWSWWPRV

SEQ ID NO: 6307 - protein, 10 aa, Artificial Sequence
  Description of Artificial Sequence:  Synthetic Peptide
WPRVTASMRM

SEQ ID NO: 6308 - protein, 10 aa, Artificial Sequence
  Description of Artificial Sequence:  Synthetic Peptide
WPRVTASMRM

SEQ ID NO: 6309 - protein, 9 aa, Artificial Sequence
  Description of Artificial Sequence:  Synthetic Peptide
MLHSPPTTL

SEQ ID NO: 6310 - protein, 9 aa, Artificial Sequence
  Description of Artificial Sequence:  Synthetic Peptide
MDHSPVRNF

SEQ ID NO: 6311 - protein, 9 aa, Artificial Sequence
  Description of Artificial Sequence:  Synthetic Peptide
QQLQAHHFL

SEQ ID NO: 6312 - protein, 9 aa, Artificial Sequence
  Description of Artificial Sequence:  Synthetic Peptide
FLQAGVGSL

SEQ ID NO: 6313 - protein, 10 aa, Artificial Sequence
  Description of Artificial Sequence:  Synthetic Peptide
AQQLQAHHFL

SEQ ID NO: 6314 - protein, 10 aa, Artificial Sequence
  Description of Artificial Sequence:  Synthetic Peptide
HFLQAGVGSL

SEQ ID NO: 6315 - protein, 10 aa, Artificial Sequence
  Description of Artificial Sequence:  Synthetic Peptide
AQQLQAHHFL

SEQ ID NO: 6316 - protein, 10 aa, Artificial Sequence
  Description of Artificial Sequence:  Synthetic Peptide
WVRAPVYRRL

SEQ ID NO: 6317 - protein, 10 aa, Artificial Sequence
  Description of Artificial Sequence:  Synthetic Peptide
RAPVYRRLQL

SEQ ID NO: 6318 - protein, 10 aa, Artificial Sequence
  Description of Artificial Sequence:  Synthetic Peptide
DVRGWVRAPV

SEQ ID NO: 6319 - protein, 9 aa, Artificial Sequence
  Description of Artificial Sequence:  Synthetic Peptide
APVYRRLQL

SEQ ID NO: 6320 - protein, 9 aa, Artificial Sequence
  Description of Artificial Sequence:  Synthetic Peptide
APVYRRLQL

SEQ ID NO: 6321 - protein, 10 aa, Artificial Sequence
  Description of Artificial Sequence:  Synthetic Peptide
RLQLDQGGAL

SEQ ID NO: 6322 - protein, 10 aa, Artificial Sequence
  Description of Artificial Sequence:  Synthetic Peptide
RAPVYRRLQL

SEQ ID NO: 6323 - protein, 10 aa, Artificial Sequence
  Description of Artificial Sequence:  Synthetic Peptide
QLDQGGALRY

SEQ ID NO: 6324 - protein, 9 aa, Artificial Sequence
  Description of Artificial Sequence:  Synthetic Peptide
QLDQGGALR

SEQ ID NO: 6325 - protein, 9 aa, Artificial Sequence
  Description of Artificial Sequence:  Synthetic Peptide
LGEPCHAER

SEQ ID NO: 6326 - protein, 10 aa, Artificial Sequence
  Description of Artificial Sequence:  Synthetic Peptide
LGEPCHAERR

SEQ ID NO: 6327 - protein, 10 aa, Artificial Sequence
  Description of Artificial Sequence:  Synthetic Peptide
LVPGGLLCGV

SEQ ID NO: 6328 - protein, 9 aa, Artificial Sequence
  Description of Artificial Sequence:  Synthetic Peptide
GLLCGVVRA

SEQ ID NO: 6329 - protein, 9 aa, Artificial Sequence
  Description of Artificial Sequence:  Synthetic Peptide
RYRLVPGGL

SEQ ID NO: 6330 - protein, 10 aa, Artificial Sequence
  Description of Artificial Sequence:  Synthetic Peptide
RYRLVPGGLL

SEQ ID NO: 6331 - protein, 10 aa, Artificial Sequence
  Description of Artificial Sequence:  Synthetic Peptide
AGQTCPGGDL

SEQ ID NO: 6332 - protein, 9 aa, Artificial Sequence
  Description of Artificial Sequence:  Synthetic Peptide
GPTRVRCPL

SEQ ID NO: 6333 - protein, 9 aa, Artificial Sequence
  Description of Artificial Sequence:  Synthetic Peptide
RPPSVGPPL

SEQ ID NO: 6334 - protein, 9 aa, Artificial Sequence
  Description of Artificial Sequence:  Synthetic Peptide
IAEFSNCHK

SEQ ID NO: 6335 - protein, 10 aa, Artificial Sequence
  Description of Artificial Sequence:  Synthetic Peptide
CSEGHRIAEF

SEQ ID NO: 6336 - protein, 9 aa, Artificial Sequence
  Description of Artificial Sequence:  Synthetic Peptide
QPRFTNALC

SEQ ID NO: 6337 - protein, 9 aa, Artificial Sequence
  Description of Artificial Sequence:  Synthetic Peptide
SEGHRIAEF

SEQ ID NO: 6338 - protein, 9 aa, Artificial Sequence
  Description of Artificial Sequence:  Synthetic Peptide
DEQAHRIRI

SEQ ID NO: 6339 - protein, 10 aa, Artificial Sequence
  Description of Artificial Sequence:  Synthetic Peptide
AEFSNCHKPA

SEQ ID NO: 6340 - protein, 10 aa, Artificial Sequence
  Description of Artificial Sequence:  Synthetic Peptide
SEGHRIAEFS

SEQ ID NO: 6341 - protein, 10 aa, Artificial Sequence
  Description of Artificial Sequence:  Synthetic Peptide
CASGKIISVL

SEQ ID NO: 6342 - protein, 9 aa, Artificial Sequence
  Description of Artificial Sequence:  Synthetic Peptide
ASGKIISVL

SEQ ID NO: 6343 - protein, 10 aa, Artificial Sequence
  Description of Artificial Sequence:  Synthetic Peptide
EEKNNSAGRF

SEQ ID NO: 6344 - protein, 10 aa, Artificial Sequence
  Description of Artificial Sequence:  Synthetic Peptide
GLELRLLVHR

SEQ ID NO: 6345 - protein, 10 aa, Artificial Sequence
  Description of Artificial Sequence:  Synthetic Peptide
GLELRLLVHR

SEQ ID NO: 6346 - protein, 10 aa, Artificial Sequence
  Description of Artificial Sequence:  Synthetic Peptide
TGRSGLELRL

SEQ ID NO: 6347 - protein, 9 aa, Artificial Sequence
  Description of Artificial Sequence:  Synthetic Peptide
RGRTGRSGL

SEQ ID NO: 6348 - protein, 9 aa, Artificial Sequence
  Description of Artificial Sequence:  Synthetic Peptide
RSGLELRLL

SEQ ID NO: 6349 - protein, 9 aa, Artificial Sequence
  Description of Artificial Sequence:  Synthetic Peptide
MVVEHLQSV

SEQ ID NO: 6350 - protein, 9 aa, Artificial Sequence
  Description of Artificial Sequence:  Synthetic Peptide
QSVEGNLPL

SEQ ID NO: 6351 - protein, 9 aa, Artificial Sequence
  Description of Artificial Sequence:  Synthetic Peptide
FLLLSTTRC

SEQ ID NO: 6352 - protein, 9 aa, Artificial Sequence
  Description of Artificial Sequence:  Synthetic Peptide
AEWADGQFL

SEQ ID NO: 6353 - protein, 9 aa, Artificial Sequence
  Description of Artificial Sequence:  Synthetic Peptide
QVRIARFSL

SEQ ID NO: 6354 - protein, 9 aa, Artificial Sequence
  Description of Artificial Sequence:  Synthetic Peptide
GPRVRHRAA

SEQ ID NO: 6355 - protein, 9 aa, Artificial Sequence
  Description of Artificial Sequence:  Synthetic Peptide
RAADHALLL

SEQ ID NO: 6356 - protein, 9 aa, Artificial Sequence
  Description of Artificial Sequence:  Synthetic Peptide
GPRVRHRAA

SEQ ID NO: 6357 - protein, 9 aa, Artificial Sequence
  Description of Artificial Sequence:  Synthetic Peptide
RAADHALLL

SEQ ID NO: 6358 - protein, 10 aa, Artificial Sequence
  Description of Artificial Sequence:  Synthetic Peptide
AEWADGQFLL

SEQ ID NO: 6359 - protein, 10 aa, Artificial Sequence
  Description of Artificial Sequence:  Synthetic Peptide
TQVRIARFSL

SEQ ID NO: 6360 - protein, 10 aa, Artificial Sequence
  Description of Artificial Sequence:  Synthetic Peptide
GPRVATQVRI

SEQ ID NO: 6361 - protein, 10 aa, Artificial Sequence
  Description of Artificial Sequence:  Synthetic Peptide
GPRVATQVRI

SEQ ID NO: 6362 - protein, 10 aa, Artificial Sequence
  Description of Artificial Sequence:  Synthetic Peptide
AEWADGQFLL

SEQ ID NO: 6363 - protein, 9 aa, Artificial Sequence
  Description of Artificial Sequence:  Synthetic Peptide
ILGRFLETL

SEQ ID NO: 6364 - protein, 9 aa, Artificial Sequence
  Description of Artificial Sequence:  Synthetic Peptide
YIIRSFPAV

SEQ ID NO: 6365 - protein, 9 aa, Artificial Sequence
  Description of Artificial Sequence:  Synthetic Peptide
VVWPSPDRK

SEQ ID NO: 6366 - protein, 9 aa, Artificial Sequence
  Description of Artificial Sequence:  Synthetic Peptide
WPSPDRKGW

SEQ ID NO: 6367 - protein, 10 aa, Artificial Sequence
  Description of Artificial Sequence:  Synthetic Peptide
TLCSHRELGV

SEQ ID NO: 6368 - protein, 10 aa, Artificial Sequence
  Description of Artificial Sequence:  Synthetic Peptide
RILGRFLETL

SEQ ID NO: 6369 - protein, 10 aa, Artificial Sequence
  Description of Artificial Sequence:  Synthetic Peptide
RILGRFLETL

SEQ ID NO: 6370 - protein, 10 aa, Artificial Sequence
  Description of Artificial Sequence:  Synthetic Peptide
SPDRKGWRIL

SEQ ID NO: 6371 - protein, 9 aa, Artificial Sequence
  Description of Artificial Sequence:  Synthetic Peptide
RPMRLASGL

SEQ ID NO: 6372 - protein, 9 aa, Artificial Sequence
  Description of Artificial Sequence:  Synthetic Peptide
RPMRLASGL

SEQ ID NO: 6373 - protein, 9 aa, Artificial Sequence
  Description of Artificial Sequence:  Synthetic Peptide
RPMRLASGL

SEQ ID NO: 6374 - protein, 9 aa, Artificial Sequence
  Description of Artificial Sequence:  Synthetic Peptide
QPYRESDLL

SEQ ID NO: 6375 - protein, 9 aa, Artificial Sequence
  Description of Artificial Sequence:  Synthetic Peptide
QPYRESDLL

SEQ ID NO: 6376 - protein, 10 aa, Artificial Sequence
  Description of Artificial Sequence:  Synthetic Peptide
GQHRNIWFWL

SEQ ID NO: 6377 - protein, 10 aa, Artificial Sequence
  Description of Artificial Sequence:  Synthetic Peptide
RSYRVGIQPY

SEQ ID NO: 6378 - protein, 9 aa, Artificial Sequence
  Description of Artificial Sequence:  Synthetic Peptide
MEVPHSAHF

SEQ ID NO: 6379 - protein, 9 aa, Artificial Sequence
  Description of Artificial Sequence:  Synthetic Peptide
QPGERWHNL

SEQ ID NO: 6380 - protein, 9 aa, Artificial Sequence
  Description of Artificial Sequence:  Synthetic Peptide
HAVPPPHAL

SEQ ID NO: 6381 - protein, 9 aa, Artificial Sequence
  Description of Artificial Sequence:  Synthetic Peptide
QPGERWHNL

SEQ ID NO: 6382 - protein, 9 aa, Artificial Sequence
  Description of Artificial Sequence:  Synthetic Peptide
QPGERWHNL

SEQ ID NO: 6383 - protein, 9 aa, Artificial Sequence
  Description of Artificial Sequence:  Synthetic Peptide
NEGQPGERW

SEQ ID NO: 6384 - protein, 10 aa, Artificial Sequence
  Description of Artificial Sequence:  Synthetic Peptide
VPPPHALVSL

SEQ ID NO: 6385 - protein, 10 aa, Artificial Sequence
  Description of Artificial Sequence:  Synthetic Peptide
VPPPHALVSL

SEQ ID NO: 6386 - protein, 9 aa, Artificial Sequence
  Description of Artificial Sequence:  Synthetic Peptide
LQQSKDFFL

SEQ ID NO: 6387 - protein, 9 aa, Artificial Sequence
  Description of Artificial Sequence:  Synthetic Peptide
SLLDVRGGL

SEQ ID NO: 6388 - protein, 9 aa, Artificial Sequence
  Description of Artificial Sequence:  Synthetic Peptide
MLVPEGLKL

SEQ ID NO: 6389 - protein, 9 aa, Artificial Sequence
  Description of Artificial Sequence:  Synthetic Peptide
LVPEGLKLL

SEQ ID NO: 6390 - protein, 9 aa, Artificial Sequence
  Description of Artificial Sequence:  Synthetic Peptide
SYYGLNDSL

SEQ ID NO: 6391 - protein, 9 aa, Artificial Sequence
  Description of Artificial Sequence:  Synthetic Peptide
YYGLNDSLL

SEQ ID NO: 6392 - protein, 9 aa, Artificial Sequence
  Description of Artificial Sequence:  Synthetic Peptide
SLLDVRGGL

SEQ ID NO: 6393 - protein, 9 aa, Artificial Sequence
  Description of Artificial Sequence:  Synthetic Peptide
KLLPVGSYY

SEQ ID NO: 6394 - protein, 9 aa, Artificial Sequence
  Description of Artificial Sequence:  Synthetic Peptide
LPVGSYYGL

SEQ ID NO: 6395 - protein, 9 aa, Artificial Sequence
  Description of Artificial Sequence:  Synthetic Peptide
LVGYCLSLL

SEQ ID NO: 6396 - protein, 9 aa, Artificial Sequence
  Description of Artificial Sequence:  Synthetic Peptide
LVPEGLKLL

SEQ ID NO: 6397 - protein, 9 aa, Artificial Sequence
  Description of Artificial Sequence:  Synthetic Peptide
QSKDFFLEL

SEQ ID NO: 6398 - protein, 9 aa, Artificial Sequence
  Description of Artificial Sequence:  Synthetic Peptide
LPVGSYYGL

SEQ ID NO: 6399 - protein, 10 aa, Artificial Sequence
  Description of Artificial Sequence:  Synthetic Peptide
SLQQSKDFFL

SEQ ID NO: 6400 - protein, 10 aa, Artificial Sequence
  Description of Artificial Sequence:  Synthetic Peptide
MLVPEGLKLL

SEQ ID NO: 6401 - protein, 10 aa, Artificial Sequence
  Description of Artificial Sequence:  Synthetic Peptide
LLPVGSYYGL

SEQ ID NO: 6402 - protein, 10 aa, Artificial Sequence
  Description of Artificial Sequence:  Synthetic Peptide
QQSKDFFLEL

SEQ ID NO: 6403 - protein, 10 aa, Artificial Sequence
  Description of Artificial Sequence:  Synthetic Peptide
YYGLNDSLLL

SEQ ID NO: 6404 - protein, 10 aa, Artificial Sequence
  Description of Artificial Sequence:  Synthetic Peptide
SYYGLNDSLL

SEQ ID NO: 6405 - protein, 10 aa, Artificial Sequence
  Description of Artificial Sequence:  Synthetic Peptide
FFLELVGYCL

SEQ ID NO: 6406 - protein, 10 aa, Artificial Sequence
  Description of Artificial Sequence:  Synthetic Peptide
LLGGSLQQSK

SEQ ID NO: 6407 - protein, 10 aa, Artificial Sequence
  Description of Artificial Sequence:  Synthetic Peptide
GLKLLPVGSY

SEQ ID NO: 6408 - protein, 10 aa, Artificial Sequence
  Description of Artificial Sequence:  Synthetic Peptide
KDFFLELVGY

SEQ ID NO: 6409 - protein, 10 aa, Artificial Sequence
  Description of Artificial Sequence:  Synthetic Peptide
YYGLNDSLLL

SEQ ID NO: 6410 - protein, 10 aa, Artificial Sequence
  Description of Artificial Sequence:  Synthetic Peptide
SYYGLNDSLL

SEQ ID NO: 6411 - protein, 10 aa, Artificial Sequence
  Description of Artificial Sequence:  Synthetic Peptide
FFLELVGYCL

SEQ ID NO: 6412 - protein, 10 aa, Artificial Sequence
  Description of Artificial Sequence:  Synthetic Peptide
LLGGSLQQSK

SEQ ID NO: 6413 - protein, 10 aa, Artificial Sequence
  Description of Artificial Sequence:  Synthetic Peptide
GLKLLPVGSY

SEQ ID NO: 6414 - protein, 10 aa, Artificial Sequence
  Description of Artificial Sequence:  Synthetic Peptide
KDFFLELVGY

SEQ ID NO: 6415 - protein, 9 aa, Artificial Sequence
  Description of Artificial Sequence:  Synthetic Peptide
RAQGHFFDV

SEQ ID NO: 6416 - protein, 9 aa, Artificial Sequence
  Description of Artificial Sequence:  Synthetic Peptide
TFRAQGHFF

SEQ ID NO: 6417 - protein, 9 aa, Artificial Sequence
  Description of Artificial Sequence:  Synthetic Peptide
VPPPLEQGY

SEQ ID NO: 6418 - protein, 10 aa, Artificial Sequence
  Description of Artificial Sequence:  Synthetic Peptide
RYSLTVEGDL

SEQ ID NO: 6419 - protein, 10 aa, Artificial Sequence
  Description of Artificial Sequence:  Synthetic Peptide
MAKDKVPPPL

SEQ ID NO: 6420 - protein, 10 aa, Artificial Sequence
  Description of Artificial Sequence:  Synthetic Peptide
MAKDKVPPPL

SEQ ID NO: 6421 - protein, 10 aa, Artificial Sequence
  Description of Artificial Sequence:  Synthetic Peptide
MAKDKVPPPL

SEQ ID NO: 6422 - protein, 9 aa, Artificial Sequence
  Description of Artificial Sequence:  Synthetic Peptide
GATPVREKL

SEQ ID NO: 6423 - protein, 9 aa, Artificial Sequence
  Description of Artificial Sequence:  Synthetic Peptide
REKLTVGGI

SEQ ID NO: 6424 - protein, 10 aa, Artificial Sequence
  Description of Artificial Sequence:  Synthetic Peptide
IVCPPGATPV

SEQ ID NO: 6425 - protein, 10 aa, Artificial Sequence
  Description of Artificial Sequence:  Synthetic Peptide
YLIALWNSRR

SEQ ID NO: 6426 - protein, 9 aa, Artificial Sequence
  Description of Artificial Sequence:  Synthetic Peptide
APSRDDIGI

SEQ ID NO: 6427 - protein, 9 aa, Artificial Sequence
  Description of Artificial Sequence:  Synthetic Peptide
MPRRAHNRT

SEQ ID NO: 6428 - protein, 9 aa, Artificial Sequence
  Description of Artificial Sequence:  Synthetic Peptide
APSRDDIGI

SEQ ID NO: 6429 - protein, 10 aa, Artificial Sequence
  Description of Artificial Sequence:  Synthetic Peptide
VPPAPSRDDI

SEQ ID NO: 6430 - protein, 10 aa, Artificial Sequence
  Description of Artificial Sequence:  Synthetic Peptide
DDIGIAGNQV

SEQ ID NO: 6431 - protein, 9 aa, Artificial Sequence
  Description of Artificial Sequence:  Synthetic Peptide
SPRNPPHCC

SEQ ID NO: 6432 - protein, 9 aa, Artificial Sequence
  Description of Artificial Sequence:  Synthetic Peptide
GARERSRTC

SEQ ID NO: 6433 - protein, 10 aa, Artificial Sequence
  Description of Artificial Sequence:  Synthetic Peptide
SPRNPPHCCT

SEQ ID NO: 6434 - protein, 9 aa, Artificial Sequence
  Description of Artificial Sequence:  Synthetic Peptide
CEIDCTWVM

SEQ ID NO: 6435 - protein, 9 aa, Artificial Sequence
  Description of Artificial Sequence:  Synthetic Peptide
HEHPHLEQC

SEQ ID NO: 6436 - protein, 9 aa, Artificial Sequence
  Description of Artificial Sequence:  Synthetic Peptide
VMPKPVWIV

SEQ ID NO: 6437 - protein, 9 aa, Artificial Sequence
  Description of Artificial Sequence:  Synthetic Peptide
QQWMLLAAV

SEQ ID NO: 6438 - protein, 9 aa, Artificial Sequence
  Description of Artificial Sequence:  Synthetic Peptide
WMLLAAVTI

SEQ ID NO: 6439 - protein, 9 aa, Artificial Sequence
  Description of Artificial Sequence:  Synthetic Peptide
WVMPKPVWI

SEQ ID NO: 6440 - protein, 9 aa, Artificial Sequence
  Description of Artificial Sequence:  Synthetic Peptide
WIVDHAAGC

SEQ ID NO: 6441 - protein, 9 aa, Artificial Sequence
  Description of Artificial Sequence:  Synthetic Peptide
EPTHEHPHL

SEQ ID NO: 6442 - protein, 9 aa, Artificial Sequence
  Description of Artificial Sequence:  Synthetic Peptide
TPAVCGLRM

SEQ ID NO: 6443 - protein, 9 aa, Artificial Sequence
  Description of Artificial Sequence:  Synthetic Peptide
GPRTTPAVC

SEQ ID NO: 6444 - protein, 9 aa, Artificial Sequence
  Description of Artificial Sequence:  Synthetic Peptide
VASGGKPVL

SEQ ID NO: 6445 - protein, 9 aa, Artificial Sequence
  Description of Artificial Sequence:  Synthetic Peptide
TPAVCGLRM

SEQ ID NO: 6446 - protein, 9 aa, Artificial Sequence
  Description of Artificial Sequence:  Synthetic Peptide
EPTHEHPHL

SEQ ID NO: 6447 - protein, 9 aa, Artificial Sequence
  Description of Artificial Sequence:  Synthetic Peptide
HPHLEQCEI

SEQ ID NO: 6448 - protein, 9 aa, Artificial Sequence
  Description of Artificial Sequence:  Synthetic Peptide
CEIDCTWVM

SEQ ID NO: 6449 - protein, 9 aa, Artificial Sequence
  Description of Artificial Sequence:  Synthetic Peptide
HEHPHLEQC

SEQ ID NO: 6450 - protein, 10 aa, Artificial Sequence
  Description of Artificial Sequence:  Synthetic Peptide
EIDCTWVMPK

SEQ ID NO: 6451 - protein, 10 aa, Artificial Sequence
  Description of Artificial Sequence:  Synthetic Peptide
WVMPKPVWIV

SEQ ID NO: 6452 - protein, 10 aa, Artificial Sequence
  Description of Artificial Sequence:  Synthetic Peptide
LLAAVTIFDI

SEQ ID NO: 6453 - protein, 10 aa, Artificial Sequence
  Description of Artificial Sequence:  Synthetic Peptide
MQQWMLLAAV

SEQ ID NO: 6454 - protein, 10 aa, Artificial Sequence
  Description of Artificial Sequence:  Synthetic Peptide
EQCEIDCTWV

SEQ ID NO: 6455 - protein, 10 aa, Artificial Sequence
  Description of Artificial Sequence:  Synthetic Peptide
EIDCTWVMPK

SEQ ID NO: 6456 - protein, 10 aa, Artificial Sequence
  Description of Artificial Sequence:  Synthetic Peptide
AVTIFDIAAL

SEQ ID NO: 6457 - protein, 10 aa, Artificial Sequence
  Description of Artificial Sequence:  Synthetic Peptide
TPAVCGLRMF

SEQ ID NO: 6458 - protein, 10 aa, Artificial Sequence
  Description of Artificial Sequence:  Synthetic Peptide
LEQCEIDCTW

SEQ ID NO: 6459 - protein, 9 aa, Artificial Sequence
  Description of Artificial Sequence:  Synthetic Peptide
KQPSYEPGV

SEQ ID NO: 6460 - protein, 9 aa, Artificial Sequence
  Description of Artificial Sequence:  Synthetic Peptide
NQLQFLLGA

SEQ ID NO: 6461 - protein, 9 aa, Artificial Sequence
  Description of Artificial Sequence:  Synthetic Peptide
LITVQGSAV

SEQ ID NO: 6462 - protein, 9 aa, Artificial Sequence
  Description of Artificial Sequence:  Synthetic Peptide
GVNQLQFLL

SEQ ID NO: 6463 - protein, 9 aa, Artificial Sequence
  Description of Artificial Sequence:  Synthetic Peptide
SYEPGVYGL

SEQ ID NO: 6464 - protein, 9 aa, Artificial Sequence
  Description of Artificial Sequence:  Synthetic Peptide
FLLGAHTKK

SEQ ID NO: 6465 - protein, 9 aa, Artificial Sequence
  Description of Artificial Sequence:  Synthetic Peptide
GVNQLQFLL

SEQ ID NO: 6466 - protein, 9 aa, Artificial Sequence
  Description of Artificial Sequence:  Synthetic Peptide
QPSYEPGVY

SEQ ID NO: 6467 - protein, 9 aa, Artificial Sequence
  Description of Artificial Sequence:  Synthetic Peptide
KASKPSGGM

SEQ ID NO: 6468 - protein, 10 aa, Artificial Sequence
  Description of Artificial Sequence:  Synthetic Peptide
FLLGAHTKKA

SEQ ID NO: 6469 - protein, 10 aa, Artificial Sequence
  Description of Artificial Sequence:  Synthetic Peptide
GLITVQGSAV

SEQ ID NO: 6470 - protein, 10 aa, Artificial Sequence
  Description of Artificial Sequence:  Synthetic Peptide
AIGVNQLQFL

SEQ ID NO: 6471 - protein, 10 aa, Artificial Sequence
  Description of Artificial Sequence:  Synthetic Peptide
SYEPGVYGLI

SEQ ID NO: 6472 - protein, 10 aa, Artificial Sequence
  Description of Artificial Sequence:  Synthetic Peptide
VPRAIGVNQL

SEQ ID NO: 6473 - protein, 10 aa, Artificial Sequence
  Description of Artificial Sequence:  Synthetic Peptide
AIGVNQLQFL

SEQ ID NO: 6474 - protein, 10 aa, Artificial Sequence
  Description of Artificial Sequence:  Synthetic Peptide
VPRAIGVNQL

SEQ ID NO: 6475 - protein, 10 aa, Artificial Sequence
  Description of Artificial Sequence:  Synthetic Peptide
VPRAIGVNQL

SEQ ID NO: 6476 - protein, 9 aa, Artificial Sequence
  Description of Artificial Sequence:  Synthetic Peptide
GLGHPQDVR

SEQ ID NO: 6477 - protein, 10 aa, Artificial Sequence
  Description of Artificial Sequence:  Synthetic Peptide
GPGYYVEQGL

SEQ ID NO: 6478 - protein, 10 aa, Artificial Sequence
  Description of Artificial Sequence:  Synthetic Peptide
GPGYYVEQGL

SEQ ID NO: 6479 - protein, 9 aa, Artificial Sequence
  Description of Artificial Sequence:  Synthetic Peptide
RYAAGCVQN

SEQ ID NO: 6480 - protein, 9 aa, Artificial Sequence
  Description of Artificial Sequence:  Synthetic Peptide
CVQNDVIGL

SEQ ID NO: 6481 - protein, 9 aa, Artificial Sequence
  Description of Artificial Sequence:  Synthetic Peptide
PARGYIVVL

SEQ ID NO: 6482 - protein, 10 aa, Artificial Sequence
  Description of Artificial Sequence:  Synthetic Peptide
GPARGYIVVL

SEQ ID NO: 6483 - protein, 10 aa, Artificial Sequence
  Description of Artificial Sequence:  Synthetic Peptide
GPARGYIVVL

SEQ ID NO: 6484 - protein, 9 aa, Artificial Sequence
  Description of Artificial Sequence:  Synthetic Peptide
LITIEGPRV

SEQ ID NO: 6485 - protein, 9 aa, Artificial Sequence
  Description of Artificial Sequence:  Synthetic Peptide
ALTRLGDRL

SEQ ID NO: 6486 - protein, 9 aa, Artificial Sequence
  Description of Artificial Sequence:  Synthetic Peptide
EPPCPPAAL

SEQ ID NO: 6487 - protein, 9 aa, Artificial Sequence
  Description of Artificial Sequence:  Synthetic Peptide
GPASALTRL

SEQ ID NO: 6488 - protein, 9 aa, Artificial Sequence
  Description of Artificial Sequence:  Synthetic Peptide
ALTRLGDRL

SEQ ID NO: 6489 - protein, 9 aa, Artificial Sequence
  Description of Artificial Sequence:  Synthetic Peptide
EPPCPPAAL

SEQ ID NO: 6490 - protein, 9 aa, Artificial Sequence
  Description of Artificial Sequence:  Synthetic Peptide
GPASALTRL

SEQ ID NO: 6491 - protein, 9 aa, Artificial Sequence
  Description of Artificial Sequence:  Synthetic Peptide
IEGPRVPGL

SEQ ID NO: 6492 - protein, 9 aa, Artificial Sequence
  Description of Artificial Sequence:  Synthetic Peptide
DERDVPHEV

SEQ ID NO: 6493 - protein, 10 aa, Artificial Sequence
  Description of Artificial Sequence:  Synthetic Peptide
ALITIEGPRV

SEQ ID NO: 6494 - protein, 10 aa, Artificial Sequence
  Description of Artificial Sequence:  Synthetic Peptide
GLSPGPASAL

SEQ ID NO: 6495 - protein, 10 aa, Artificial Sequence
  Description of Artificial Sequence:  Synthetic Peptide
RLGDRLSSSA

SEQ ID NO: 6496 - protein, 10 aa, Artificial Sequence
  Description of Artificial Sequence:  Synthetic Peptide
VIWAPRWTGA

SEQ ID NO: 6497 - protein, 10 aa, Artificial Sequence
  Description of Artificial Sequence:  Synthetic Peptide
SALTRLGDRL

SEQ ID NO: 6498 - protein, 10 aa, Artificial Sequence
  Description of Artificial Sequence:  Synthetic Peptide
EPPCPPAALI

SEQ ID NO: 6499 - protein, 10 aa, Artificial Sequence
  Description of Artificial Sequence:  Synthetic Peptide
IEGPRVPGLS

SEQ ID NO: 6500 - protein, 9 aa, Artificial Sequence
  Description of Artificial Sequence:  Synthetic Peptide
QGSDPWWSV

SEQ ID NO: 6501 - protein, 9 aa, Artificial Sequence
  Description of Artificial Sequence:  Synthetic Peptide
FPREDRSSS

SEQ ID NO: 6502 - protein, 10 aa, Artificial Sequence
  Description of Artificial Sequence:  Synthetic Peptide
GSDPWWSVAS

SEQ ID NO: 6503 - protein, 10 aa, Artificial Sequence
  Description of Artificial Sequence:  Synthetic Peptide
SQGSDPWWSV

SEQ ID NO: 6504 - protein, 9 aa, Artificial Sequence
  Description of Artificial Sequence:  Synthetic Peptide
SMTLSRTPL

SEQ ID NO: 6505 - protein, 10 aa, Artificial Sequence
  Description of Artificial Sequence:  Synthetic Peptide
MSMTLSRTPL

SEQ ID NO: 6506 - protein, 10 aa, Artificial Sequence
  Description of Artificial Sequence:  Synthetic Peptide
TPLPGRGAPW

SEQ ID NO: 6507 - protein, 9 aa, Artificial Sequence
  Description of Artificial Sequence:  Synthetic Peptide
QLVVHNPEL

SEQ ID NO: 6508 - protein, 9 aa, Artificial Sequence
  Description of Artificial Sequence:  Synthetic Peptide
VVRHIHGQL

SEQ ID NO: 6509 - protein, 9 aa, Artificial Sequence
  Description of Artificial Sequence:  Synthetic Peptide
GPTVEDCSL

SEQ ID NO: 6510 - protein, 9 aa, Artificial Sequence
  Description of Artificial Sequence:  Synthetic Peptide
GPTVEDCSL

SEQ ID NO: 6511 - protein, 9 aa, Artificial Sequence
  Description of Artificial Sequence:  Synthetic Peptide
EEGPAERPV

SEQ ID NO: 6512 - protein, 10 aa, Artificial Sequence
  Description of Artificial Sequence:  Synthetic Peptide
SSEEEGPAER

SEQ ID NO: 6513 - protein, 10 aa, Artificial Sequence
  Description of Artificial Sequence:  Synthetic Peptide
VVVRHIHGQL

SEQ ID NO: 6514 - protein, 10 aa, Artificial Sequence
  Description of Artificial Sequence:  Synthetic Peptide
TPRTHWNRPA

SEQ ID NO: 6515 - protein, 10 aa, Artificial Sequence
  Description of Artificial Sequence:  Synthetic Peptide
VVRHIHGQLV

SEQ ID NO: 6516 - protein, 10 aa, Artificial Sequence
  Description of Artificial Sequence:  Synthetic Peptide
AERPVVVRHI

SEQ ID NO: 6517 - protein, 9 aa, Artificial Sequence
  Description of Artificial Sequence:  Synthetic Peptide
KVYWVRWCT

SEQ ID NO: 6518 - protein, 9 aa, Artificial Sequence
  Description of Artificial Sequence:  Synthetic Peptide
LLLPRKDSV

SEQ ID NO: 6519 - protein, 9 aa, Artificial Sequence
  Description of Artificial Sequence:  Synthetic Peptide
LPRKDSVST

SEQ ID NO: 6520 - protein, 9 aa, Artificial Sequence
  Description of Artificial Sequence:  Synthetic Peptide
RPPATRPCI

SEQ ID NO: 6521 - protein, 9 aa, Artificial Sequence
  Description of Artificial Sequence:  Synthetic Peptide
RPPATRPCI

SEQ ID NO: 6522 - protein, 10 aa, Artificial Sequence
  Description of Artificial Sequence:  Synthetic Peptide
RLLLPRKDSV

SEQ ID NO: 6523 - protein, 10 aa, Artificial Sequence
  Description of Artificial Sequence:  Synthetic Peptide
LLPRKDSVST

SEQ ID NO: 6524 - protein, 9 aa, Artificial Sequence
  Description of Artificial Sequence:  Synthetic Peptide
YLGPYGHDV

SEQ ID NO: 6525 - protein, 9 aa, Artificial Sequence
  Description of Artificial Sequence:  Synthetic Peptide
DVGCGKPHL

SEQ ID NO: 6526 - protein, 9 aa, Artificial Sequence
  Description of Artificial Sequence:  Synthetic Peptide
WNRSVWHQL

SEQ ID NO: 6527 - protein, 9 aa, Artificial Sequence
  Description of Artificial Sequence:  Synthetic Peptide
RPRETYRRW

SEQ ID NO: 6528 - protein, 10 aa, Artificial Sequence
  Description of Artificial Sequence:  Synthetic Peptide
RWNRSVWHQL

SEQ ID NO: 6529 - protein, 10 aa, Artificial Sequence
  Description of Artificial Sequence:  Synthetic Peptide
RPRETYRRWN

SEQ ID NO: 6530 - protein, 10 aa, Artificial Sequence
  Description of Artificial Sequence:  Synthetic Peptide
RSNPRPRETY

SEQ ID NO: 6531 - protein, 9 aa, Artificial Sequence
  Description of Artificial Sequence:  Synthetic Peptide
EELNCQRKM

SEQ ID NO: 6532 - protein, 10 aa, Artificial Sequence
  Description of Artificial Sequence:  Synthetic Peptide
RCRSGHEGIL

SEQ ID NO: 6533 - protein, 10 aa, Artificial Sequence
  Description of Artificial Sequence:  Synthetic Peptide
VPRKRPGPLC

SEQ ID NO: 6534 - protein, 10 aa, Artificial Sequence
  Description of Artificial Sequence:  Synthetic Peptide
LVPRKRPGPL

SEQ ID NO: 6535 - protein, 9 aa, Artificial Sequence
  Description of Artificial Sequence:  Synthetic Peptide
RAPHHTGCM

SEQ ID NO: 6536 - protein, 9 aa, Artificial Sequence
  Description of Artificial Sequence:  Synthetic Peptide
APHHTGCMW

SEQ ID NO: 6537 - protein, 10 aa, Artificial Sequence
  Description of Artificial Sequence:  Synthetic Peptide
GMDSRPCSGV

SEQ ID NO: 6538 - protein, 9 aa, Artificial Sequence
  Description of Artificial Sequence:  Synthetic Peptide
RAEPRTGLR

SEQ ID NO: 6539 - protein, 10 aa, Artificial Sequence
  Description of Artificial Sequence:  Synthetic Peptide
RAEPRTGLRS

SEQ ID NO: 6540 - protein, 10 aa, Artificial Sequence
  Description of Artificial Sequence:  Synthetic Peptide
ATLPTRSPHY

SEQ ID NO: 6541 - protein, 10 aa, Artificial Sequence
  Description of Artificial Sequence:  Synthetic Peptide
GTRAEPRTGL

SEQ ID NO: 6542 - protein, 10 aa, Artificial Sequence
  Description of Artificial Sequence:  Synthetic Peptide
GSRAGTGATL

SEQ ID NO: 6543 - protein, 10 aa, Artificial Sequence
  Description of Artificial Sequence:  Synthetic Peptide
EPRTGLRSDA

SEQ ID NO: 6544 - protein, 10 aa, Artificial Sequence
  Description of Artificial Sequence:  Synthetic Peptide
GSRAGTGATL

SEQ ID NO: 6545 - protein, 10 aa, Artificial Sequence
  Description of Artificial Sequence:  Synthetic Peptide
ATLPTRSPHY

SEQ ID NO: 6546 - protein, 9 aa, Artificial Sequence
  Description of Artificial Sequence:  Synthetic Peptide
GLEAARHSY

SEQ ID NO: 6547 - protein, 9 aa, Artificial Sequence
  Description of Artificial Sequence:  Synthetic Peptide
GLEAARHSY

SEQ ID NO: 6548 - protein, 9 aa, Artificial Sequence
  Description of Artificial Sequence:  Synthetic Peptide
MALPGGGGL

SEQ ID NO: 6549 - protein, 9 aa, Artificial Sequence
  Description of Artificial Sequence:  Synthetic Peptide
LVLVRTAQL

SEQ ID NO: 6550 - protein, 9 aa, Artificial Sequence
  Description of Artificial Sequence:  Synthetic Peptide
QMDKSNWPA

SEQ ID NO: 6551 - protein, 9 aa, Artificial Sequence
  Description of Artificial Sequence:  Synthetic Peptide
RGSGVSLVL

SEQ ID NO: 6552 - protein, 9 aa, Artificial Sequence
  Description of Artificial Sequence:  Synthetic Peptide
VLVRTAQLK

SEQ ID NO: 6553 - protein, 9 aa, Artificial Sequence
  Description of Artificial Sequence:  Synthetic Peptide
LVLVRTAQL

SEQ ID NO: 6554 - protein, 9 aa, Artificial Sequence
  Description of Artificial Sequence:  Synthetic Peptide
PARGSGVSL

SEQ ID NO: 6555 - protein, 10 aa, Artificial Sequence
  Description of Artificial Sequence:  Synthetic Peptide
NQMDKSNWPA

SEQ ID NO: 6556 - protein, 10 aa, Artificial Sequence
  Description of Artificial Sequence:  Synthetic Peptide
SLVLVRTAQL

SEQ ID NO: 6557 - protein, 10 aa, Artificial Sequence
  Description of Artificial Sequence:  Synthetic Peptide
VLVRTAQLKR

SEQ ID NO: 6558 - protein, 10 aa, Artificial Sequence
  Description of Artificial Sequence:  Synthetic Peptide
WPARGSGVSL

SEQ ID NO: 6559 - protein, 10 aa, Artificial Sequence
  Description of Artificial Sequence:  Synthetic Peptide
FPPTPTVNQM

SEQ ID NO: 6560 - protein, 10 aa, Artificial Sequence
  Description of Artificial Sequence:  Synthetic Peptide
FPPTPTVNQM

SEQ ID NO: 6561 - protein, 10 aa, Artificial Sequence
  Description of Artificial Sequence:  Synthetic Peptide
WPARGSGVSL

SEQ ID NO: 6562 - protein, 9 aa, Artificial Sequence
  Description of Artificial Sequence:  Synthetic Peptide
MIAGKSSGV

SEQ ID NO: 6563 - protein, 9 aa, Artificial Sequence
  Description of Artificial Sequence:  Synthetic Peptide
MMMLPNQEL

SEQ ID NO: 6564 - protein, 9 aa, Artificial Sequence
  Description of Artificial Sequence:  Synthetic Peptide
MMLPNQELT

SEQ ID NO: 6565 - protein, 9 aa, Artificial Sequence
  Description of Artificial Sequence:  Synthetic Peptide
IITMRTQMV

SEQ ID NO: 6566 - protein, 9 aa, Artificial Sequence
  Description of Artificial Sequence:  Synthetic Peptide
MVGAYMMML

SEQ ID NO: 6567 - protein, 9 aa, Artificial Sequence
  Description of Artificial Sequence:  Synthetic Peptide
MMMLPNQEL

SEQ ID NO: 6568 - protein, 9 aa, Artificial Sequence
  Description of Artificial Sequence:  Synthetic Peptide
MEKKCVIIT

SEQ ID NO: 6569 - protein, 10 aa, Artificial Sequence
  Description of Artificial Sequence:  Synthetic Peptide
MLPNQELTGV

SEQ ID NO: 6570 - protein, 10 aa, Artificial Sequence
  Description of Artificial Sequence:  Synthetic Peptide
YMMMLPNQEL

SEQ ID NO: 6571 - protein, 10 aa, Artificial Sequence
  Description of Artificial Sequence:  Synthetic Peptide
QMVGAYMMML

SEQ ID NO: 6572 - protein, 10 aa, Artificial Sequence
  Description of Artificial Sequence:  Synthetic Peptide
MMMLPNQELT

SEQ ID NO: 6573 - protein, 10 aa, Artificial Sequence
  Description of Artificial Sequence:  Synthetic Peptide
VIITMRTQMV

SEQ ID NO: 6574 - protein, 10 aa, Artificial Sequence
  Description of Artificial Sequence:  Synthetic Peptide
QMVGAYMMML

SEQ ID NO: 6575 - protein, 10 aa, Artificial Sequence
  Description of Artificial Sequence:  Synthetic Peptide
YMMMLPNQEL

SEQ ID NO: 6576 - protein, 9 aa, Artificial Sequence
  Description of Artificial Sequence:  Synthetic Peptide
VSYENPKGV

SEQ ID NO: 6577 - protein, 9 aa, Artificial Sequence
  Description of Artificial Sequence:  Synthetic Peptide
SYENPKGVF

SEQ ID NO: 6578 - protein, 9 aa, Artificial Sequence
  Description of Artificial Sequence:  Synthetic Peptide
GVFFEVHIL

SEQ ID NO: 6579 - protein, 9 aa, Artificial Sequence
  Description of Artificial Sequence:  Synthetic Peptide
NPKGVFFEV

SEQ ID NO: 6580 - protein, 9 aa, Artificial Sequence
  Description of Artificial Sequence:  Synthetic Peptide
YENPKGVFF

SEQ ID NO: 6581 - protein, 9 aa, Artificial Sequence
  Description of Artificial Sequence:  Synthetic Peptide
VESKQRVSY

SEQ ID NO: 6582 - protein, 10 aa, Artificial Sequence
  Description of Artificial Sequence:  Synthetic Peptide
TVESKQRVSY

SEQ ID NO: 6583 - protein, 10 aa, Artificial Sequence
  Description of Artificial Sequence:  Synthetic Peptide
SYENPKGVFF

SEQ ID NO: 6584 - protein, 10 aa, Artificial Sequence
  Description of Artificial Sequence:  Synthetic Peptide
KGVFFEVHIL

SEQ ID NO: 6585 - protein, 10 aa, Artificial Sequence
  Description of Artificial Sequence:  Synthetic Peptide
VSYENPKGVF

SEQ ID NO: 6586 - protein, 9 aa, Artificial Sequence
  Description of Artificial Sequence:  Synthetic Peptide
SQTERIWLM

SEQ ID NO: 6587 - protein, 9 aa, Artificial Sequence
  Description of Artificial Sequence:  Synthetic Peptide
ALYPNFDRA

SEQ ID NO: 6588 - protein, 9 aa, Artificial Sequence
  Description of Artificial Sequence:  Synthetic Peptide
MMVVGIGVV

SEQ ID NO: 6589 - protein, 9 aa, Artificial Sequence
  Description of Artificial Sequence:  Synthetic Peptide
KERTSFALY

SEQ ID NO: 6590 - protein, 10 aa, Artificial Sequence
  Description of Artificial Sequence:  Synthetic Peptide
MMVVGIGVVV

SEQ ID NO: 6591 - protein, 10 aa, Artificial Sequence
  Description of Artificial Sequence:  Synthetic Peptide
LLDKERTSFA

SEQ ID NO: 6592 - protein, 10 aa, Artificial Sequence
  Description of Artificial Sequence:  Synthetic Peptide
RIWLMALLDK

SEQ ID NO: 6593 - protein, 10 aa, Artificial Sequence
  Description of Artificial Sequence:  Synthetic Peptide
KSSQTERIWL

SEQ ID NO: 6594 - protein, 10 aa, Artificial Sequence
  Description of Artificial Sequence:  Synthetic Peptide
SSQTERIWLM

SEQ ID NO: 6595 - protein, 9 aa, Artificial Sequence
  Description of Artificial Sequence:  Synthetic Peptide
FTLDARSFT

SEQ ID NO: 6596 - protein, 9 aa, Artificial Sequence
  Description of Artificial Sequence:  Synthetic Peptide
MVSMRAFTL

SEQ ID NO: 6597 - protein, 9 aa, Artificial Sequence
  Description of Artificial Sequence:  Synthetic Peptide
SFTSFNTVL

SEQ ID NO: 6598 - protein, 9 aa, Artificial Sequence
  Description of Artificial Sequence:  Synthetic Peptide
AFTLDARSF

SEQ ID NO: 6599 - protein, 9 aa, Artificial Sequence
  Description of Artificial Sequence:  Synthetic Peptide
MVSMRAFTL

SEQ ID NO: 6600 - protein, 9 aa, Artificial Sequence
  Description of Artificial Sequence:  Synthetic Peptide
LDARSFTSF

SEQ ID NO: 6601 - protein, 10 aa, Artificial Sequence
  Description of Artificial Sequence:  Synthetic Peptide
RSFTSFNTVL

SEQ ID NO: 6602 - protein, 9 aa, Artificial Sequence
  Description of Artificial Sequence:  Synthetic Peptide
TVDQESQLK

SEQ ID NO: 6603 - protein, 9 aa, Artificial Sequence
  Description of Artificial Sequence:  Synthetic Peptide
TLCSSLSLT

SEQ ID NO: 6604 - protein, 9 aa, Artificial Sequence
  Description of Artificial Sequence:  Synthetic Peptide
SARNAADTL

SEQ ID NO: 6605 - protein, 9 aa, Artificial Sequence
  Description of Artificial Sequence:  Synthetic Peptide
SPPGEGGTL

SEQ ID NO: 6606 - protein, 9 aa, Artificial Sequence
  Description of Artificial Sequence:  Synthetic Peptide
CVSTPEEEL

SEQ ID NO: 6607 - protein, 9 aa, Artificial Sequence
  Description of Artificial Sequence:  Synthetic Peptide
SARNAADTL

SEQ ID NO: 6608 - protein, 9 aa, Artificial Sequence
  Description of Artificial Sequence:  Synthetic Peptide
SPPGEGGTL

SEQ ID NO: 6609 - protein, 9 aa, Artificial Sequence
  Description of Artificial Sequence:  Synthetic Peptide
EELFSSCGF

SEQ ID NO: 6610 - protein, 9 aa, Artificial Sequence
  Description of Artificial Sequence:  Synthetic Peptide
DEHDSESDS

SEQ ID NO: 6611 - protein, 10 aa, Artificial Sequence
  Description of Artificial Sequence:  Synthetic Peptide
ALHGVIRAPV

SEQ ID NO: 6612 - protein, 10 aa, Artificial Sequence
  Description of Artificial Sequence:  Synthetic Peptide
TLCSSLSLTV

SEQ ID NO: 6613 - protein, 10 aa, Artificial Sequence
  Description of Artificial Sequence:  Synthetic Peptide
SLTVDQESQL

SEQ ID NO: 6614 - protein, 10 aa, Artificial Sequence
  Description of Artificial Sequence:  Synthetic Peptide
GTLEVVLDCV

SEQ ID NO: 6615 - protein, 10 aa, Artificial Sequence
  Description of Artificial Sequence:  Synthetic Peptide
EYDIEQQTTL

SEQ ID NO: 6616 - protein, 10 aa, Artificial Sequence
  Description of Artificial Sequence:  Synthetic Peptide
SPGSPSRGGM

SEQ ID NO: 6617 - protein, 10 aa, Artificial Sequence
  Description of Artificial Sequence:  Synthetic Peptide
ASARNAADTL

SEQ ID NO: 6618 - protein, 10 aa, Artificial Sequence
  Description of Artificial Sequence:  Synthetic Peptide
SPGSPSRGGM

SEQ ID NO: 6619 - protein, 10 aa, Artificial Sequence
  Description of Artificial Sequence:  Synthetic Peptide
EEELFSSCGF

SEQ ID NO: 6620 - protein, 10 aa, Artificial Sequence
  Description of Artificial Sequence:  Synthetic Peptide
LLPISCRHNK

SEQ ID NO: 6621 - protein, 10 aa, Artificial Sequence
  Description of Artificial Sequence:  Synthetic Peptide
LPISCRHNKL

SEQ ID NO: 6622 - protein, 10 aa, Artificial Sequence
  Description of Artificial Sequence:  Synthetic Peptide
SCRHNKLAFT

SEQ ID NO: 6623 - protein, 10 aa, Artificial Sequence
  Description of Artificial Sequence:  Synthetic Peptide
LPISCRHNKL

SEQ ID NO: 6624 - protein, 10 aa, Artificial Sequence
  Description of Artificial Sequence:  Synthetic Peptide
LPISCRHNKL

SEQ ID NO: 6625 - protein, 9 aa, Artificial Sequence
  Description of Artificial Sequence:  Synthetic Peptide
HVRGPASRM

SEQ ID NO: 6626 - protein, 9 aa, Artificial Sequence
  Description of Artificial Sequence:  Synthetic Peptide
GPASRMDPF

SEQ ID NO: 6627 - protein, 10 aa, Artificial Sequence
  Description of Artificial Sequence:  Synthetic Peptide
KVPCHMLAHV

SEQ ID NO: 6628 - protein, 10 aa, Artificial Sequence
  Description of Artificial Sequence:  Synthetic Peptide
GPASRMDPFF

SEQ ID NO: 6629 - protein, 9 aa, Artificial Sequence
  Description of Artificial Sequence:  Synthetic Peptide
IILAESHDL

SEQ ID NO: 6630 - protein, 9 aa, Artificial Sequence
  Description of Artificial Sequence:  Synthetic Peptide
QMIRSQSSL

SEQ ID NO: 6631 - protein, 9 aa, Artificial Sequence
  Description of Artificial Sequence:  Synthetic Peptide
RSQSSLQGL

SEQ ID NO: 6632 - protein, 9 aa, Artificial Sequence
  Description of Artificial Sequence:  Synthetic Peptide
ILAESHDLK

SEQ ID NO: 6633 - protein, 9 aa, Artificial Sequence
  Description of Artificial Sequence:  Synthetic Peptide
SPGSAGIIL

SEQ ID NO: 6634 - protein, 9 aa, Artificial Sequence
  Description of Artificial Sequence:  Synthetic Peptide
SPGSAGIIL

SEQ ID NO: 6635 - protein, 9 aa, Artificial Sequence
  Description of Artificial Sequence:  Synthetic Peptide
RSQSSLQGL

SEQ ID NO: 6636 - protein, 10 aa, Artificial Sequence
  Description of Artificial Sequence:  Synthetic Peptide
SQMIRSQSSL

SEQ ID NO: 6637 - protein, 9 aa, Artificial Sequence
  Description of Artificial Sequence:  Synthetic Peptide
VTEAVNAIR

SEQ ID NO: 6638 - protein, 9 aa, Artificial Sequence
  Description of Artificial Sequence:  Synthetic Peptide
ATHPPSMLK

SEQ ID NO: 6639 - protein, 9 aa, Artificial Sequence
  Description of Artificial Sequence:  Synthetic Peptide
GSSPPMILK

SEQ ID NO: 6640 - protein, 9 aa, Artificial Sequence
  Description of Artificial Sequence:  Synthetic Peptide
SMLKNIVWL

SEQ ID NO: 6641 - protein, 9 aa, Artificial Sequence
  Description of Artificial Sequence:  Synthetic Peptide
ELWGPAKWV

SEQ ID NO: 6642 - protein, 9 aa, Artificial Sequence
  Description of Artificial Sequence:  Synthetic Peptide
MLKNIVWLV

SEQ ID NO: 6643 - protein, 9 aa, Artificial Sequence
  Description of Artificial Sequence:  Synthetic Peptide
WIPLTKFHI

SEQ ID NO: 6644 - protein, 9 aa, Artificial Sequence
  Description of Artificial Sequence:  Synthetic Peptide
LVTEAVNAI

SEQ ID NO: 6645 - protein, 9 aa, Artificial Sequence
  Description of Artificial Sequence:  Synthetic Peptide
WLVVRGLVT

SEQ ID NO: 6646 - protein, 9 aa, Artificial Sequence
  Description of Artificial Sequence:  Synthetic Peptide
KASSFCQLV

SEQ ID NO: 6647 - protein, 9 aa, Artificial Sequence
  Description of Artificial Sequence:  Synthetic Peptide
SMAAHITPT

SEQ ID NO: 6648 - protein, 9 aa, Artificial Sequence
  Description of Artificial Sequence:  Synthetic Peptide
IVWLVVRGL

SEQ ID NO: 6649 - protein, 9 aa, Artificial Sequence
  Description of Artificial Sequence:  Synthetic Peptide
TLPRPIPPM

SEQ ID NO: 6650 - protein, 9 aa, Artificial Sequence
  Description of Artificial Sequence:  Synthetic Peptide
SMTACCWVA

SEQ ID NO: 6651 - protein, 9 aa, Artificial Sequence
  Description of Artificial Sequence:  Synthetic Peptide
RTFSLNWWA

SEQ ID NO: 6652 - protein, 9 aa, Artificial Sequence
  Description of Artificial Sequence:  Synthetic Peptide
RYWIPLTKF

SEQ ID NO: 6653 - protein, 9 aa, Artificial Sequence
  Description of Artificial Sequence:  Synthetic Peptide
AIRDATAGL

SEQ ID NO: 6654 - protein, 9 aa, Artificial Sequence
  Description of Artificial Sequence:  Synthetic Peptide
RPARYWIPL

SEQ ID NO: 6655 - protein, 9 aa, Artificial Sequence
  Description of Artificial Sequence:  Synthetic Peptide
TPAPYPARM

SEQ ID NO: 6656 - protein, 9 aa, Artificial Sequence
  Description of Artificial Sequence:  Synthetic Peptide
LPRPIPPMA

SEQ ID NO: 6657 - protein, 9 aa, Artificial Sequence
  Description of Artificial Sequence:  Synthetic Peptide
IVWLVVRGL

SEQ ID NO: 6658 - protein, 9 aa, Artificial Sequence
  Description of Artificial Sequence:  Synthetic Peptide
VATHPPSML

SEQ ID NO: 6659 - protein, 9 aa, Artificial Sequence
  Description of Artificial Sequence:  Synthetic Peptide
TTRAPGDSM

SEQ ID NO: 6660 - protein, 9 aa, Artificial Sequence
  Description of Artificial Sequence:  Synthetic Peptide
PARMSSKTL

SEQ ID NO: 6661 - protein, 9 aa, Artificial Sequence
  Description of Artificial Sequence:  Synthetic Peptide
RPARYWIPL

SEQ ID NO: 6662 - protein, 9 aa, Artificial Sequence
  Description of Artificial Sequence:  Synthetic Peptide
TPAPYPARM

SEQ ID NO: 6663 - protein, 9 aa, Artificial Sequence
  Description of Artificial Sequence:  Synthetic Peptide
NPRTFSLNW

SEQ ID NO: 6664 - protein, 9 aa, Artificial Sequence
  Description of Artificial Sequence:  Synthetic Peptide
KAPETPAPY

SEQ ID NO: 6665 - protein, 9 aa, Artificial Sequence
  Description of Artificial Sequence:  Synthetic Peptide
EELWGPAKW

SEQ ID NO: 6666 - protein, 9 aa, Artificial Sequence
  Description of Artificial Sequence:  Synthetic Peptide
VERPARYWI

SEQ ID NO: 6667 - protein, 10 aa, Artificial Sequence
  Description of Artificial Sequence:  Synthetic Peptide
SMLKNIVWLV

SEQ ID NO: 6668 - protein, 10 aa, Artificial Sequence
  Description of Artificial Sequence:  Synthetic Peptide
CLCQKASSFC

SEQ ID NO: 6669 - protein, 10 aa, Artificial Sequence
  Description of Artificial Sequence:  Synthetic Peptide
GLVTEAVNAI

SEQ ID NO: 6670 - protein, 10 aa, Artificial Sequence
  Description of Artificial Sequence:  Synthetic Peptide
IVWLVVRGLV

SEQ ID NO: 6671 - protein, 10 aa, Artificial Sequence
  Description of Artificial Sequence:  Synthetic Peptide
KPLTTNAEEL

SEQ ID NO: 6672 - protein, 10 aa, Artificial Sequence
  Description of Artificial Sequence:  Synthetic Peptide
AVGSSPPMIL

SEQ ID NO: 6673 - protein, 10 aa, Artificial Sequence
  Description of Artificial Sequence:  Synthetic Peptide
YPARMSSKTL

SEQ ID NO: 6674 - protein, 10 aa, Artificial Sequence
  Description of Artificial Sequence:  Synthetic Peptide
KPLTTNAEEL

SEQ ID NO: 6675 - protein, 10 aa, Artificial Sequence
  Description of Artificial Sequence:  Synthetic Peptide
IPLTKFHICL

SEQ ID NO: 6676 - protein, 10 aa, Artificial Sequence
  Description of Artificial Sequence:  Synthetic Peptide
PPMAAPAKPL

SEQ ID NO: 6677 - protein, 10 aa, Artificial Sequence
  Description of Artificial Sequence:  Synthetic Peptide
LPRPIPPMAA

SEQ ID NO: 6678 - protein, 10 aa, Artificial Sequence
  Description of Artificial Sequence:  Synthetic Peptide
WVATHPPSML

SEQ ID NO: 6679 - protein, 10 aa, Artificial Sequence
  Description of Artificial Sequence:  Synthetic Peptide
SPGPTCRRSM

SEQ ID NO: 6680 - protein, 10 aa, Artificial Sequence
  Description of Artificial Sequence:  Synthetic Peptide
NAIRDATAGL

SEQ ID NO: 6681 - protein, 10 aa, Artificial Sequence
  Description of Artificial Sequence:  Synthetic Peptide
VVRGLVTEAV

SEQ ID NO: 6682 - protein, 10 aa, Artificial Sequence
  Description of Artificial Sequence:  Synthetic Peptide
SPGPTCRRSM

SEQ ID NO: 6683 - protein, 10 aa, Artificial Sequence
  Description of Artificial Sequence:  Synthetic Peptide
KPLTTNAEEL

SEQ ID NO: 6684 - protein, 10 aa, Artificial Sequence
  Description of Artificial Sequence:  Synthetic Peptide
NPRTFSLNWW

SEQ ID NO: 6685 - protein, 10 aa, Artificial Sequence
  Description of Artificial Sequence:  Synthetic Peptide
IPLTKFHICL

SEQ ID NO: 6686 - protein, 10 aa, Artificial Sequence
  Description of Artificial Sequence:  Synthetic Peptide
YPARMSSKTL

SEQ ID NO: 6687 - protein, 10 aa, Artificial Sequence
  Description of Artificial Sequence:  Synthetic Peptide
SSFCQLVATM

SEQ ID NO: 6688 - protein, 10 aa, Artificial Sequence
  Description of Artificial Sequence:  Synthetic Peptide
DSMAGNRLTM

SEQ ID NO: 6689 - protein, 10 aa, Artificial Sequence
  Description of Artificial Sequence:  Synthetic Peptide
SSAVGSSPPM

SEQ ID NO: 6690 - protein, 10 aa, Artificial Sequence
  Description of Artificial Sequence:  Synthetic Peptide
AEELWGPAKW

SEQ ID NO: 6691 - protein, 10 aa, Artificial Sequence
  Description of Artificial Sequence:  Synthetic Peptide
EELWGPAKWV

SEQ ID NO: 6692 - protein, 10 aa, Artificial Sequence
  Description of Artificial Sequence:  Synthetic Peptide
TEAVNAIRDA

SEQ ID NO: 6693 - protein, 9 aa, Artificial Sequence
  Description of Artificial Sequence:  Synthetic Peptide
CEHSSISSY

SEQ ID NO: 6694 - protein, 10 aa, Artificial Sequence
  Description of Artificial Sequence:  Synthetic Peptide
ACEHSSISSY

SEQ ID NO: 6695 - protein, 9 aa, Artificial Sequence
  Description of Artificial Sequence:  Synthetic Peptide
AMTYFVMGC

SEQ ID NO: 6696 - protein, 9 aa, Artificial Sequence
  Description of Artificial Sequence:  Synthetic Peptide
FVMGCDKQI

SEQ ID NO: 6697 - protein, 9 aa, Artificial Sequence
  Description of Artificial Sequence:  Synthetic Peptide
RYKRGVGPC

SEQ ID NO: 6698 - protein, 9 aa, Artificial Sequence
  Description of Artificial Sequence:  Synthetic Peptide
GVGPCSVGL

SEQ ID NO: 6699 - protein, 9 aa, Artificial Sequence
  Description of Artificial Sequence:  Synthetic Peptide
LSRTRHFHV

SEQ ID NO: 6700 - protein, 10 aa, Artificial Sequence
  Description of Artificial Sequence:  Synthetic Peptide
GLSRTRHFHV

SEQ ID NO: 6701 - protein, 10 aa, Artificial Sequence
  Description of Artificial Sequence:  Synthetic Peptide
RYKRGVGPCS

SEQ ID NO: 6702 - protein, 10 aa, Artificial Sequence
  Description of Artificial Sequence:  Synthetic Peptide
RGVGPCSVGL

SEQ ID NO: 6703 - protein, 10 aa, Artificial Sequence
  Description of Artificial Sequence:  Synthetic Peptide
ISFWTGPNRY

SEQ ID NO: 6704 - protein, 9 aa, Artificial Sequence
  Description of Artificial Sequence:  Synthetic Peptide
MTESKSPVY

SEQ ID NO: 6705 - protein, 9 aa, Artificial Sequence
  Description of Artificial Sequence:  Synthetic Peptide
SMTESKSPV

SEQ ID NO: 6706 - protein, 9 aa, Artificial Sequence
  Description of Artificial Sequence:  Synthetic Peptide
GMTDTSRPL

SEQ ID NO: 6707 - protein, 9 aa, Artificial Sequence
  Description of Artificial Sequence:  Synthetic Peptide
TLQSMTESK

SEQ ID NO: 6708 - protein, 9 aa, Artificial Sequence
  Description of Artificial Sequence:  Synthetic Peptide
CSTATLQSM

SEQ ID NO: 6709 - protein, 10 aa, Artificial Sequence
  Description of Artificial Sequence:  Synthetic Peptide
VGMTDTSRPL

SEQ ID NO: 6710 - protein, 10 aa, Artificial Sequence
  Description of Artificial Sequence:  Synthetic Peptide
ESKSPVYPVM

SEQ ID NO: 6711 - protein, 10 aa, Artificial Sequence
  Description of Artificial Sequence:  Synthetic Peptide
KSTYCSTATL

SEQ ID NO: 6712 - protein, 10 aa, Artificial Sequence
  Description of Artificial Sequence:  Synthetic Peptide
TESKSPVYPV

SEQ ID NO: 6713 - protein, 9 aa, Artificial Sequence
  Description of Artificial Sequence:  Synthetic Peptide
VMLPGGVRV

SEQ ID NO: 6714 - protein, 10 aa, Artificial Sequence
  Description of Artificial Sequence:  Synthetic Peptide
TVMLPGGVRV

SEQ ID NO: 6715 - protein, 10 aa, Artificial Sequence
  Description of Artificial Sequence:  Synthetic Peptide
MLPGGVRVAK

SEQ ID NO: 6716 - protein, 10 aa, Artificial Sequence
  Description of Artificial Sequence:  Synthetic Peptide
GVRVAKTVSL

SEQ ID NO: 6717 - protein, 10 aa, Artificial Sequence
  Description of Artificial Sequence:  Synthetic Peptide
GVRVAKTVSL

SEQ ID NO: 6718 - protein, 9 aa, Artificial Sequence
  Description of Artificial Sequence:  Synthetic Peptide
DGFSTRTVY

SEQ ID NO: 6719 - protein, 10 aa, Artificial Sequence
  Description of Artificial Sequence:  Synthetic Peptide
KPSVAATDGF

SEQ ID NO: 6720 - protein, 10 aa, Artificial Sequence
  Description of Artificial Sequence:  Synthetic Peptide
TDGFSTRTVY

SEQ ID NO: 6721 - protein, 10 aa, Artificial Sequence
  Description of Artificial Sequence:  Synthetic Peptide
KEPKPSVAAT

SEQ ID NO: 6722 - protein, 9 aa, Artificial Sequence
  Description of Artificial Sequence:  Synthetic Peptide
GLGLSKLAV

SEQ ID NO: 6723 - protein, 9 aa, Artificial Sequence
  Description of Artificial Sequence:  Synthetic Peptide
KYKSAEPQA

SEQ ID NO: 6724 - protein, 9 aa, Artificial Sequence
  Description of Artificial Sequence:  Synthetic Peptide
KLAVESPLR

SEQ ID NO: 6725 - protein, 9 aa, Artificial Sequence
  Description of Artificial Sequence:  Synthetic Peptide
EPLRQARGL

SEQ ID NO: 6726 - protein, 9 aa, Artificial Sequence
  Description of Artificial Sequence:  Synthetic Peptide
TPLVHTAAL

SEQ ID NO: 6727 - protein, 9 aa, Artificial Sequence
  Description of Artificial Sequence:  Synthetic Peptide
NCRAFATPL

SEQ ID NO: 6728 - protein, 9 aa, Artificial Sequence
  Description of Artificial Sequence:  Synthetic Peptide
NCRAFATPL

SEQ ID NO: 6729 - protein, 9 aa, Artificial Sequence
  Description of Artificial Sequence:  Synthetic Peptide
TPLVHTAAL

SEQ ID NO: 6730 - protein, 9 aa, Artificial Sequence
  Description of Artificial Sequence:  Synthetic Peptide
EPLRQARGL

SEQ ID NO: 6731 - protein, 9 aa, Artificial Sequence
  Description of Artificial Sequence:  Synthetic Peptide
TSASRVTKY

SEQ ID NO: 6732 - protein, 9 aa, Artificial Sequence
  Description of Artificial Sequence:  Synthetic Peptide
ESPLRRAGM

SEQ ID NO: 6733 - protein, 9 aa, Artificial Sequence
  Description of Artificial Sequence:  Synthetic Peptide
TSASRVTKY

SEQ ID NO: 6734 - protein, 10 aa, Artificial Sequence
  Description of Artificial Sequence:  Synthetic Peptide
SAEPQAHGSR

SEQ ID NO: 6735 - protein, 10 aa, Artificial Sequence
  Description of Artificial Sequence:  Synthetic Peptide
GMTSASRVTK

SEQ ID NO: 6736 - protein, 10 aa, Artificial Sequence
  Description of Artificial Sequence:  Synthetic Peptide
KLAVESPLRR

SEQ ID NO: 6737 - protein, 10 aa, Artificial Sequence
  Description of Artificial Sequence:  Synthetic Peptide
QARGLGLSKL

SEQ ID NO: 6738 - protein, 10 aa, Artificial Sequence
  Description of Artificial Sequence:  Synthetic Peptide
EPQAHGSRDL

SEQ ID NO: 6739 - protein, 10 aa, Artificial Sequence
  Description of Artificial Sequence:  Synthetic Peptide
ATPLVHTAAL

SEQ ID NO: 6740 - protein, 10 aa, Artificial Sequence
  Description of Artificial Sequence:  Synthetic Peptide
IPATCPEGHI

SEQ ID NO: 6741 - protein, 10 aa, Artificial Sequence
  Description of Artificial Sequence:  Synthetic Peptide
QARGLGLSKL

SEQ ID NO: 6742 - protein, 10 aa, Artificial Sequence
  Description of Artificial Sequence:  Synthetic Peptide
PLRQARGLGL

SEQ ID NO: 6743 - protein, 10 aa, Artificial Sequence
  Description of Artificial Sequence:  Synthetic Peptide
EPQAHGSRDL

SEQ ID NO: 6744 - protein, 10 aa, Artificial Sequence
  Description of Artificial Sequence:  Synthetic Peptide
LSKLAVESPL

SEQ ID NO: 6745 - protein, 10 aa, Artificial Sequence
  Description of Artificial Sequence:  Synthetic Peptide
MTSASRVTKY

SEQ ID NO: 6746 - protein, 9 aa, Artificial Sequence
  Description of Artificial Sequence:  Synthetic Peptide
TLISMGLNI

SEQ ID NO: 6747 - protein, 9 aa, Artificial Sequence
  Description of Artificial Sequence:  Synthetic Peptide
RPAAAQCCI

SEQ ID NO: 6748 - protein, 9 aa, Artificial Sequence
  Description of Artificial Sequence:  Synthetic Peptide
CCIGARWSY

SEQ ID NO: 6749 - protein, 10 aa, Artificial Sequence
  Description of Artificial Sequence:  Synthetic Peptide
TARSLRPAAA

SEQ ID NO: 6750 - protein, 9 aa, Artificial Sequence
  Description of Artificial Sequence:  Synthetic Peptide
ITERTSMQR

SEQ ID NO: 6751 - protein, 9 aa, Artificial Sequence
  Description of Artificial Sequence:  Synthetic Peptide
IIWKYFPPI

SEQ ID NO: 6752 - protein, 9 aa, Artificial Sequence
  Description of Artificial Sequence:  Synthetic Peptide
MLSMIIWKY

SEQ ID NO: 6753 - protein, 10 aa, Artificial Sequence
  Description of Artificial Sequence:  Synthetic Peptide
IIWKYFPPIT

SEQ ID NO: 6754 - protein, 10 aa, Artificial Sequence
  Description of Artificial Sequence:  Synthetic Peptide
KYFPPITERT

SEQ ID NO: 6755 - protein, 10 aa, Artificial Sequence
  Description of Artificial Sequence:  Synthetic Peptide
FPPITERTSM

SEQ ID NO: 6756 - protein, 10 aa, Artificial Sequence
  Description of Artificial Sequence:  Synthetic Peptide
FPPITERTSM

SEQ ID NO: 6757 - protein, 9 aa, Artificial Sequence
  Description of Artificial Sequence:  Synthetic Peptide
KTPAPRVAL

SEQ ID NO: 6758 - protein, 9 aa, Artificial Sequence
  Description of Artificial Sequence:  Synthetic Peptide
CLYQGDKVK

SEQ ID NO: 6759 - protein, 9 aa, Artificial Sequence
  Description of Artificial Sequence:  Synthetic Peptide
HIRRPIQCL

SEQ ID NO: 6760 - protein, 9 aa, Artificial Sequence
  Description of Artificial Sequence:  Synthetic Peptide
LPRASKGGT

SEQ ID NO: 6761 - protein, 9 aa, Artificial Sequence
  Description of Artificial Sequence:  Synthetic Peptide
KPKRAKTPA

SEQ ID NO: 6762 - protein, 9 aa, Artificial Sequence
  Description of Artificial Sequence:  Synthetic Peptide
ADSHLHMVY

SEQ ID NO: 6763 - protein, 10 aa, Artificial Sequence
  Description of Artificial Sequence:  Synthetic Peptide
RADSHLHMVY

SEQ ID NO: 6764 - protein, 10 aa, Artificial Sequence
  Description of Artificial Sequence:  Synthetic Peptide
ALSSPDHAYA

SEQ ID NO: 6765 - protein, 10 aa, Artificial Sequence
  Description of Artificial Sequence:  Synthetic Peptide
CLYQGDKVKK

SEQ ID NO: 6766 - protein, 10 aa, Artificial Sequence
  Description of Artificial Sequence:  Synthetic Peptide
HMVYWFHHIR

SEQ ID NO: 6767 - protein, 10 aa, Artificial Sequence
  Description of Artificial Sequence:  Synthetic Peptide
KARGQRPVRL

SEQ ID NO: 6768 - protein, 10 aa, Artificial Sequence
  Description of Artificial Sequence:  Synthetic Peptide
KARGQRPVRL

SEQ ID NO: 6769 - protein, 10 aa, Artificial Sequence
  Description of Artificial Sequence:  Synthetic Peptide
KARGQRPVRL

SEQ ID NO: 6770 - protein, 9 aa, Artificial Sequence
  Description of Artificial Sequence:  Synthetic Peptide
RMTNSHFSA

SEQ ID NO: 6771 - protein, 10 aa, Artificial Sequence
  Description of Artificial Sequence:  Synthetic Peptide
NSHFSAHPTM

SEQ ID NO: 6772 - protein, 9 aa, Artificial Sequence
  Description of Artificial Sequence:  Synthetic Peptide
TLNNVKLTV

SEQ ID NO: 6773 - protein, 9 aa, Artificial Sequence
  Description of Artificial Sequence:  Synthetic Peptide
ILTLNNVKL

SEQ ID NO: 6774 - protein, 9 aa, Artificial Sequence
  Description of Artificial Sequence:  Synthetic Peptide
QLQAAVNRC

SEQ ID NO: 6775 - protein, 9 aa, Artificial Sequence
  Description of Artificial Sequence:  Synthetic Peptide
NPPTNILTL

SEQ ID NO: 6776 - protein, 9 aa, Artificial Sequence
  Description of Artificial Sequence:  Synthetic Peptide
SQRSPLVQL

SEQ ID NO: 6777 - protein, 9 aa, Artificial Sequence
  Description of Artificial Sequence:  Synthetic Peptide
NPPTNILTL

SEQ ID NO: 6778 - protein, 10 aa, Artificial Sequence
  Description of Artificial Sequence:  Synthetic Peptide
ILTLNNVKLT

SEQ ID NO: 6779 - protein, 10 aa, Artificial Sequence
  Description of Artificial Sequence:  Synthetic Peptide
NILTLNNVKL

SEQ ID NO: 6780 - protein, 10 aa, Artificial Sequence
  Description of Artificial Sequence:  Synthetic Peptide
CIRPVDSAGM

SEQ ID NO: 6781 - protein, 10 aa, Artificial Sequence
  Description of Artificial Sequence:  Synthetic Peptide
RPVDSAGMGV

SEQ ID NO: 6782 - protein, 10 aa, Artificial Sequence
  Description of Artificial Sequence:  Synthetic Peptide
RSSISQRSPL

SEQ ID NO: 6783 - protein, 9 aa, Artificial Sequence
  Description of Artificial Sequence:  Synthetic Peptide
LYVASGCFL

SEQ ID NO: 6784 - protein, 9 aa, Artificial Sequence
  Description of Artificial Sequence:  Synthetic Peptide
FLKQSVGQK

SEQ ID NO: 6785 - protein, 10 aa, Artificial Sequence
  Description of Artificial Sequence:  Synthetic Peptide
RLYVASGCFL

SEQ ID NO: 6786 - protein, 9 aa, Artificial Sequence
  Description of Artificial Sequence:  Synthetic Peptide
VLTNPVEFI

SEQ ID NO: 6787 - protein, 9 aa, Artificial Sequence
  Description of Artificial Sequence:  Synthetic Peptide
APHVLTNPV

SEQ ID NO: 6788 - protein, 9 aa, Artificial Sequence
  Description of Artificial Sequence:  Synthetic Peptide
SSRNTSVSF

SEQ ID NO: 6789 - protein, 9 aa, Artificial Sequence
  Description of Artificial Sequence:  Synthetic Peptide
GEAPHVLTN

SEQ ID NO: 6790 - protein, 9 aa, Artificial Sequence
  Description of Artificial Sequence:  Synthetic Peptide
VMGLQLLSL

SEQ ID NO: 6791 - protein, 9 aa, Artificial Sequence
  Description of Artificial Sequence:  Synthetic Peptide
SVKGPHPCL

SEQ ID NO: 6792 - protein, 10 aa, Artificial Sequence
  Description of Artificial Sequence:  Synthetic Peptide
KVMGLQLLSL

SEQ ID NO: 6793 - protein, 10 aa, Artificial Sequence
  Description of Artificial Sequence:  Synthetic Peptide
KVMGLQLLSL

SEQ ID NO: 6794 - protein, 10 aa, Artificial Sequence
  Description of Artificial Sequence:  Synthetic Peptide
HPCLKKVMGL

SEQ ID NO: 6795 - protein, 10 aa, Artificial Sequence
  Description of Artificial Sequence:  Synthetic Peptide
KVMGLQLLSL

SEQ ID NO: 6796 - protein, 10 aa, Artificial Sequence
  Description of Artificial Sequence:  Synthetic Peptide
GPHPCLKKVM

SEQ ID NO: 6797 - protein, 10 aa, Artificial Sequence
  Description of Artificial Sequence:  Synthetic Peptide
ASVKGPHPCL

SEQ ID NO: 6798 - protein, 10 aa, Artificial Sequence
  Description of Artificial Sequence:  Synthetic Peptide
HPCLKKVMGL

SEQ ID NO: 6799 - protein, 10 aa, Artificial Sequence
  Description of Artificial Sequence:  Synthetic Peptide
GPHPCLKKVM

SEQ ID NO: 6800 - protein, 10 aa, Artificial Sequence
  Description of Artificial Sequence:  Synthetic Peptide
HPCLKKVMGL

SEQ ID NO: 6801 - protein, 9 aa, Artificial Sequence
  Description of Artificial Sequence:  Synthetic Peptide
LLMCHEPLV

SEQ ID NO: 6802 - protein, 9 aa, Artificial Sequence
  Description of Artificial Sequence:  Synthetic Peptide
VLLMCHEPL

SEQ ID NO: 6803 - protein, 9 aa, Artificial Sequence
  Description of Artificial Sequence:  Synthetic Peptide
FMDSLQFRA

SEQ ID NO: 6804 - protein, 9 aa, Artificial Sequence
  Description of Artificial Sequence:  Synthetic Peptide
SLQFRAVLL

SEQ ID NO: 6805 - protein, 9 aa, Artificial Sequence
  Description of Artificial Sequence:  Synthetic Peptide
LVLTSCSFC

SEQ ID NO: 6806 - protein, 9 aa, Artificial Sequence
  Description of Artificial Sequence:  Synthetic Peptide
LMCHEPLVL

SEQ ID NO: 6807 - protein, 9 aa, Artificial Sequence
  Description of Artificial Sequence:  Synthetic Peptide
HEPLVLTSC

SEQ ID NO: 6808 - protein, 10 aa, Artificial Sequence
  Description of Artificial Sequence:  Synthetic Peptide
VLLMCHEPLV

SEQ ID NO: 6809 - protein, 10 aa, Artificial Sequence
  Description of Artificial Sequence:  Synthetic Peptide
VLTSCSFCWA

SEQ ID NO: 6810 - protein, 10 aa, Artificial Sequence
  Description of Artificial Sequence:  Synthetic Peptide
LLMCHEPLVL

SEQ ID NO: 6811 - protein, 10 aa, Artificial Sequence
  Description of Artificial Sequence:  Synthetic Peptide
FMDSLQFRAV

SEQ ID NO: 6812 - protein, 10 aa, Artificial Sequence
  Description of Artificial Sequence:  Synthetic Peptide
LMCHEPLVLT

SEQ ID NO: 6813 - protein, 10 aa, Artificial Sequence
  Description of Artificial Sequence:  Synthetic Peptide
FCWAPTLKRL

SEQ ID NO: 6814 - protein, 10 aa, Artificial Sequence
  Description of Artificial Sequence:  Synthetic Peptide
SLQFRAVLLM

SEQ ID NO: 6815 - protein, 10 aa, Artificial Sequence
  Description of Artificial Sequence:  Synthetic Peptide
AVLLMCHEPL

SEQ ID NO: 6816 - protein, 10 aa, Artificial Sequence
  Description of Artificial Sequence:  Synthetic Peptide
LLMCHEPLVL

SEQ ID NO: 6817 - protein, 10 aa, Artificial Sequence
  Description of Artificial Sequence:  Synthetic Peptide
NPVFMDSLQF

SEQ ID NO: 6818 - protein, 10 aa, Artificial Sequence
  Description of Artificial Sequence:  Synthetic Peptide
EPLVLTSCSF

SEQ ID NO: 6819 - protein, 9 aa, Artificial Sequence
  Description of Artificial Sequence:  Synthetic Peptide
MMIATLAQL

SEQ ID NO: 6820 - protein, 9 aa, Artificial Sequence
  Description of Artificial Sequence:  Synthetic Peptide
IMSNKVWGT

SEQ ID NO: 6821 - protein, 9 aa, Artificial Sequence
  Description of Artificial Sequence:  Synthetic Peptide
SEQLQVWTV

SEQ ID NO: 6822 - protein, 9 aa, Artificial Sequence
  Description of Artificial Sequence:  Synthetic Peptide
QFIIISQAI

SEQ ID NO: 6823 - protein, 9 aa, Artificial Sequence
  Description of Artificial Sequence:  Synthetic Peptide
RWPGYSEQL

SEQ ID NO: 6824 - protein, 9 aa, Artificial Sequence
  Description of Artificial Sequence:  Synthetic Peptide
IPRAGNQFI

SEQ ID NO: 6825 - protein, 9 aa, Artificial Sequence
  Description of Artificial Sequence:  Synthetic Peptide
MPQWAPAIM

SEQ ID NO: 6826 - protein, 9 aa, Artificial Sequence
  Description of Artificial Sequence:  Synthetic Peptide
APAIMSNKV

SEQ ID NO: 6827 - protein, 9 aa, Artificial Sequence
  Description of Artificial Sequence:  Synthetic Peptide
MPQWAPAIM

SEQ ID NO: 6828 - protein, 9 aa, Artificial Sequence
  Description of Artificial Sequence:  Synthetic Peptide
IPRAGNQFI

SEQ ID NO: 6829 - protein, 9 aa, Artificial Sequence
  Description of Artificial Sequence:  Synthetic Peptide
SEQLQVWTV

SEQ ID NO: 6830 - protein, 10 aa, Artificial Sequence
  Description of Artificial Sequence:  Synthetic Peptide
AIMSNKVWGT

SEQ ID NO: 6831 - protein, 10 aa, Artificial Sequence
  Description of Artificial Sequence:  Synthetic Peptide
TVWWRRGLNV

SEQ ID NO: 6832 - protein, 10 aa, Artificial Sequence
  Description of Artificial Sequence:  Synthetic Peptide
KVWGTRRTCA

SEQ ID NO: 6833 - protein, 10 aa, Artificial Sequence
  Description of Artificial Sequence:  Synthetic Peptide
QLQVWTVWWR

SEQ ID NO: 6834 - protein, 10 aa, Artificial Sequence
  Description of Artificial Sequence:  Synthetic Peptide
GLNVKACPTR

SEQ ID NO: 6835 - protein, 10 aa, Artificial Sequence
  Description of Artificial Sequence:  Synthetic Peptide
IPRAGNQFII

SEQ ID NO: 6836 - protein, 10 aa, Artificial Sequence
  Description of Artificial Sequence:  Synthetic Peptide
IPRAGNQFII

SEQ ID NO: 6837 - protein, 10 aa, Artificial Sequence
  Description of Artificial Sequence:  Synthetic Peptide
APAIMSNKVW

SEQ ID NO: 6838 - protein, 10 aa, Artificial Sequence
  Description of Artificial Sequence:  Synthetic Peptide
SEQLQVWTVW

SEQ ID NO: 6839 - protein, 10 aa, Artificial Sequence
  Description of Artificial Sequence:  Synthetic Peptide
TAIPRAGNQF

SEQ ID NO: 6840 - protein, 9 aa, Artificial Sequence
  Description of Artificial Sequence:  Synthetic Peptide
ILLLEQSLV

SEQ ID NO: 6841 - protein, 9 aa, Artificial Sequence
  Description of Artificial Sequence:  Synthetic Peptide
TILLLEQSL

SEQ ID NO: 6842 - protein, 9 aa, Artificial Sequence
  Description of Artificial Sequence:  Synthetic Peptide
LLLEQSLVR

SEQ ID NO: 6843 - protein, 9 aa, Artificial Sequence
  Description of Artificial Sequence:  Synthetic Peptide
SASYTILLL

SEQ ID NO: 6844 - protein, 10 aa, Artificial Sequence
  Description of Artificial Sequence:  Synthetic Peptide
LLLEQSLVRT

SEQ ID NO: 6845 - protein, 10 aa, Artificial Sequence
  Description of Artificial Sequence:  Synthetic Peptide
TILLLEQSLV

SEQ ID NO: 6846 - protein, 10 aa, Artificial Sequence
  Description of Artificial Sequence:  Synthetic Peptide
ILLLEQSLVR

SEQ ID NO: 6847 - protein, 9 aa, Artificial Sequence
  Description of Artificial Sequence:  Synthetic Peptide
HPAHPQPSL

SEQ ID NO: 6848 - protein, 9 aa, Artificial Sequence
  Description of Artificial Sequence:  Synthetic Peptide
RVSMTLPKL

SEQ ID NO: 6849 - protein, 9 aa, Artificial Sequence
  Description of Artificial Sequence:  Synthetic Peptide
HPAHPQPSL

SEQ ID NO: 6850 - protein, 10 aa, Artificial Sequence
  Description of Artificial Sequence:  Synthetic Peptide
NPHVRVSMTL

SEQ ID NO: 6851 - protein, 10 aa, Artificial Sequence
  Description of Artificial Sequence:  Synthetic Peptide
EPRGDRSHPA

SEQ ID NO: 6852 - protein, 10 aa, Artificial Sequence
  Description of Artificial Sequence:  Synthetic Peptide
YPMRSANPHV

SEQ ID NO: 6853 - protein, 10 aa, Artificial Sequence
  Description of Artificial Sequence:  Synthetic Peptide
EPRGDRSHPA

SEQ ID NO: 6854 - protein, 10 aa, Artificial Sequence
  Description of Artificial Sequence:  Synthetic Peptide
NPHVRVSMTL

SEQ ID NO: 6855 - protein, 10 aa, Artificial Sequence
  Description of Artificial Sequence:  Synthetic Peptide
KLRDLRRGSF

SEQ ID NO: 6856 - protein, 9 aa, Artificial Sequence
  Description of Artificial Sequence:  Synthetic Peptide
FLLVFLCGL

SEQ ID NO: 6857 - protein, 9 aa, Artificial Sequence
  Description of Artificial Sequence:  Synthetic Peptide
LMLHGLRDL

SEQ ID NO: 6858 - protein, 9 aa, Artificial Sequence
  Description of Artificial Sequence:  Synthetic Peptide
FLCGLGSVL

SEQ ID NO: 6859 - protein, 9 aa, Artificial Sequence
  Description of Artificial Sequence:  Synthetic Peptide
MVFLLVFLC

SEQ ID NO: 6860 - protein, 9 aa, Artificial Sequence
  Description of Artificial Sequence:  Synthetic Peptide
PYQAVPQGL

SEQ ID NO: 6861 - protein, 9 aa, Artificial Sequence
  Description of Artificial Sequence:  Synthetic Peptide
GLSRPNTTR

SEQ ID NO: 6862 - protein, 9 aa, Artificial Sequence
  Description of Artificial Sequence:  Synthetic Peptide
LSRPNTTRL

SEQ ID NO: 6863 - protein, 9 aa, Artificial Sequence
  Description of Artificial Sequence:  Synthetic Peptide
RPNTTRLVI

SEQ ID NO: 6864 - protein, 9 aa, Artificial Sequence
  Description of Artificial Sequence:  Synthetic Peptide
LPGHSQAPY

SEQ ID NO: 6865 - protein, 9 aa, Artificial Sequence
  Description of Artificial Sequence:  Synthetic Peptide
RPNTTRLVI

SEQ ID NO: 6866 - protein, 9 aa, Artificial Sequence
  Description of Artificial Sequence:  Synthetic Peptide
LSRPNTTRL

SEQ ID NO: 6867 - protein, 10 aa, Artificial Sequence
  Description of Artificial Sequence:  Synthetic Peptide
VLMLHGLRDL

SEQ ID NO: 6868 - protein, 10 aa, Artificial Sequence
  Description of Artificial Sequence:  Synthetic Peptide
FLCGLGSVLM

SEQ ID NO: 6869 - protein, 10 aa, Artificial Sequence
  Description of Artificial Sequence:  Synthetic Peptide
GLSRPNTTRL

SEQ ID NO: 6870 - protein, 10 aa, Artificial Sequence
  Description of Artificial Sequence:  Synthetic Peptide
LVFLCGLGSV

SEQ ID NO: 6871 - protein, 10 aa, Artificial Sequence
  Description of Artificial Sequence:  Synthetic Peptide
VFLCGLGSVL

SEQ ID NO: 6872 - protein, 10 aa, Artificial Sequence
  Description of Artificial Sequence:  Synthetic Peptide
VFLLVFLCGL

SEQ ID NO: 6873 - protein, 10 aa, Artificial Sequence
  Description of Artificial Sequence:  Synthetic Peptide
APYQAVPQGL

SEQ ID NO: 6874 - protein, 10 aa, Artificial Sequence
  Description of Artificial Sequence:  Synthetic Peptide
VLMLHGLRDL

SEQ ID NO: 6875 - protein, 10 aa, Artificial Sequence
  Description of Artificial Sequence:  Synthetic Peptide
APYQAVPQGL

SEQ ID NO: 6876 - protein, 9 aa, Artificial Sequence
  Description of Artificial Sequence:  Synthetic Peptide
ALVRVSCSL

SEQ ID NO: 6877 - protein, 10 aa, Artificial Sequence
  Description of Artificial Sequence:  Synthetic Peptide
MALVRVSCSL

SEQ ID NO: 6878 - protein, 9 aa, Artificial Sequence
  Description of Artificial Sequence:  Synthetic Peptide
ALVRVSCSL

SEQ ID NO: 6879 - protein, 9 aa, Artificial Sequence
  Description of Artificial Sequence:  Synthetic Peptide
GVDPATWVR

SEQ ID NO: 6880 - protein, 10 aa, Artificial Sequence
  Description of Artificial Sequence:  Synthetic Peptide
GVDPATWVRS

SEQ ID NO: 6881 - protein, 10 aa, Artificial Sequence
  Description of Artificial Sequence:  Synthetic Peptide
LADGVSLPPR

SEQ ID NO: 6882 - protein, 9 aa, Artificial Sequence
  Description of Artificial Sequence:  Synthetic Peptide
KMTPGVDPA

SEQ ID NO: 6883 - protein, 10 aa, Artificial Sequence
  Description of Artificial Sequence:  Synthetic Peptide
KMTPGVDPAT

SEQ ID NO: 6884 - protein, 10 aa, Artificial Sequence
  Description of Artificial Sequence:  Synthetic Peptide
VLAPAGAKMT

SEQ ID NO: 6885 - protein, 9 aa, Artificial Sequence
  Description of Artificial Sequence:  Synthetic Peptide
GPGPSPGTL

SEQ ID NO: 6886 - protein, 9 aa, Artificial Sequence
  Description of Artificial Sequence:  Synthetic Peptide
WVCAKQVRL

SEQ ID NO: 6887 - protein, 10 aa, Artificial Sequence
  Description of Artificial Sequence:  Synthetic Peptide
QVRLPSDHNL

SEQ ID NO: 6888 - protein, 9 aa, Artificial Sequence
  Description of Artificial Sequence:  Synthetic Peptide
GPGPSPGTL

SEQ ID NO: 6889 - protein, 9 aa, Artificial Sequence
  Description of Artificial Sequence:  Synthetic Peptide
TPGVDPATW

SEQ ID NO: 6890 - protein, 10 aa, Artificial Sequence
  Description of Artificial Sequence:  Synthetic Peptide
RLAYICLPTT

SEQ ID NO: 6891 - protein, 10 aa, Artificial Sequence
  Description of Artificial Sequence:  Synthetic Peptide
LPTTAPTGAL

SEQ ID NO: 6892 - protein, 10 aa, Artificial Sequence
  Description of Artificial Sequence:  Synthetic Peptide
LPTTAPTGAL

SEQ ID NO: 6893 - protein, 10 aa, Artificial Sequence
  Description of Artificial Sequence:  Synthetic Peptide
ALHPHRWWWA

SEQ ID NO: 6894 - protein, 10 aa, Artificial Sequence
  Description of Artificial Sequence:  Synthetic Peptide
APLILKACQL

SEQ ID NO: 6895 - protein, 10 aa, Artificial Sequence
  Description of Artificial Sequence:  Synthetic Peptide
HPHRWWWAPL

SEQ ID NO: 6896 - protein, 10 aa, Artificial Sequence
  Description of Artificial Sequence:  Synthetic Peptide
HPHRWWWAPL

SEQ ID NO: 6897 - protein, 10 aa, Artificial Sequence
  Description of Artificial Sequence:  Synthetic Peptide
APLILKACQL

SEQ ID NO: 6898 - protein, 10 aa, Artificial Sequence
  Description of Artificial Sequence:  Synthetic Peptide
LPAAGPGPGL

SEQ ID NO: 6899 - protein, 9 aa, Artificial Sequence
  Description of Artificial Sequence:  Synthetic Peptide
GPGLRQGVW

SEQ ID NO: 6900 - protein, 9 aa, Artificial Sequence
  Description of Artificial Sequence:  Synthetic Peptide
RGESAVILK

SEQ ID NO: 6901 - protein, 9 aa, Artificial Sequence
  Description of Artificial Sequence:  Synthetic Peptide
VILKIVTAV

SEQ ID NO: 6902 - protein, 10 aa, Artificial Sequence
  Description of Artificial Sequence:  Synthetic Peptide
AVILKIVTAV

SEQ ID NO: 6903 - protein, 10 aa, Artificial Sequence
  Description of Artificial Sequence:  Synthetic Peptide
TGRGESAVIL

SEQ ID NO: 6904 - protein, 9 aa, Artificial Sequence
  Description of Artificial Sequence:  Synthetic Peptide
CLFEVVGTV

SEQ ID NO: 6905 - protein, 10 aa, Artificial Sequence
  Description of Artificial Sequence:  Synthetic Peptide
YGSPPCLFEV

SEQ ID NO: 6906 - protein, 9 aa, Artificial Sequence
  Description of Artificial Sequence:  Synthetic Peptide
KYGSPPCLF

SEQ ID NO: 6907 - protein, 10 aa, Artificial Sequence
  Description of Artificial Sequence:  Synthetic Peptide
PYHHGISTGL

SEQ ID NO: 6908 - protein, 10 aa, Artificial Sequence
  Description of Artificial Sequence:  Synthetic Peptide
VLSGGTSMPY

SEQ ID NO: 6909 - protein, 9 aa, Artificial Sequence
  Description of Artificial Sequence:  Synthetic Peptide
AVLSGGTSM

SEQ ID NO: 6910 - protein, 9 aa, Artificial Sequence
  Description of Artificial Sequence:  Synthetic Peptide
LSGGTSMPY

SEQ ID NO: 6911 - protein, 10 aa, Artificial Sequence
  Description of Artificial Sequence:  Synthetic Peptide
CSCSSGSLPY

SEQ ID NO: 6912 - protein, 9 aa, Artificial Sequence
  Description of Artificial Sequence:  Synthetic Peptide
AGVRPPCKY

SEQ ID NO: 6913 - protein, 9 aa, Artificial Sequence
  Description of Artificial Sequence:  Synthetic Peptide
KLGDYLELL

SEQ ID NO: 6914 - protein, 9 aa, Artificial Sequence
  Description of Artificial Sequence:  Synthetic Peptide
SLVLWRLRL

SEQ ID NO: 6915 - protein, 10 aa, Artificial Sequence
  Description of Artificial Sequence:  Synthetic Peptide
RGWAASCCWV

SEQ ID NO: 6916 - protein, 9 aa, Artificial Sequence
  Description of Artificial Sequence:  Synthetic Peptide
RSQHTPSKL

SEQ ID NO: 6917 - protein, 9 aa, Artificial Sequence
  Description of Artificial Sequence:  Synthetic Peptide
RWPRSPSSL

SEQ ID NO: 6918 - protein, 9 aa, Artificial Sequence
  Description of Artificial Sequence:  Synthetic Peptide
DYLELLSPA

SEQ ID NO: 6919 - protein, 10 aa, Artificial Sequence
  Description of Artificial Sequence:  Synthetic Peptide
GLPRVSKDWR

SEQ ID NO: 6920 - protein, 9 aa, Artificial Sequence
  Description of Artificial Sequence:  Synthetic Peptide
TPSKLGDYL

SEQ ID NO: 6921 - protein, 9 aa, Artificial Sequence
  Description of Artificial Sequence:  Synthetic Peptide
WPRSPSSLV

SEQ ID NO: 6922 - protein, 9 aa, Artificial Sequence
  Description of Artificial Sequence:  Synthetic Peptide
AASCCWVRL

SEQ ID NO: 6923 - protein, 10 aa, Artificial Sequence
  Description of Artificial Sequence:  Synthetic Peptide
WPRSPSSLVL

SEQ ID NO: 6924 - protein, 10 aa, Artificial Sequence
  Description of Artificial Sequence:  Synthetic Peptide
SPSSLVLWRL

SEQ ID NO: 6925 - protein, 10 aa, Artificial Sequence
  Description of Artificial Sequence:  Synthetic Peptide
WAASCCWVRL

SEQ ID NO: 6926 - protein, 10 aa, Artificial Sequence
  Description of Artificial Sequence:  Synthetic Peptide
WPRSPSSLVL

SEQ ID NO: 6927 - protein, 9 aa, Artificial Sequence
  Description of Artificial Sequence:  Synthetic Peptide
TPSKLGDYL

SEQ ID NO: 6928 - protein, 9 aa, Artificial Sequence
  Description of Artificial Sequence:  Synthetic Peptide
WPRSPSSLV

SEQ ID NO: 6929 - protein, 9 aa, Artificial Sequence
  Description of Artificial Sequence:  Synthetic Peptide
RSQHTPSKL

SEQ ID NO: 6930 - protein, 10 aa, Artificial Sequence
  Description of Artificial Sequence:  Synthetic Peptide
WPRSPSSLVL

SEQ ID NO: 6931 - protein, 10 aa, Artificial Sequence
  Description of Artificial Sequence:  Synthetic Peptide
LPRVSKDWRW

SEQ ID NO: 6932 - protein, 10 aa, Artificial Sequence
  Description of Artificial Sequence:  Synthetic Peptide
SPSSLVLWRL

SEQ ID NO: 6933 - protein, 10 aa, Artificial Sequence
  Description of Artificial Sequence:  Synthetic Peptide
AETSCAGCPF

SEQ ID NO: 6934 - protein, 9 aa, Artificial Sequence
  Description of Artificial Sequence:  Synthetic Peptide
VLGRGLLLV

SEQ ID NO: 6935 - protein, 9 aa, Artificial Sequence
  Description of Artificial Sequence:  Synthetic Peptide
MVLGRGLLL

SEQ ID NO: 6936 - protein, 10 aa, Artificial Sequence
  Description of Artificial Sequence:  Synthetic Peptide
MVLGRGLLLV

SEQ ID NO: 6937 - protein, 10 aa, Artificial Sequence
  Description of Artificial Sequence:  Synthetic Peptide
VLGRGLLLVT

SEQ ID NO: 6938 - protein, 9 aa, Artificial Sequence
  Description of Artificial Sequence:  Synthetic Peptide
GPRFKCTPM

SEQ ID NO: 6939 - protein, 9 aa, Artificial Sequence
  Description of Artificial Sequence:  Synthetic Peptide
MVLGRGLLL

SEQ ID NO: 6940 - protein, 9 aa, Artificial Sequence
  Description of Artificial Sequence:  Synthetic Peptide
GPRFKCTPM

SEQ ID NO: 6941 - protein, 9 aa, Artificial Sequence
  Description of Artificial Sequence:  Synthetic Peptide
GPRFKCTPM

SEQ ID NO: 6942 - protein, 10 aa, Artificial Sequence
  Description of Artificial Sequence:  Synthetic Peptide
GPRFKCTPMW

SEQ ID NO: 6943 - protein, 10 aa, Artificial Sequence
  Description of Artificial Sequence:  Synthetic Peptide
TPHTASSSPM

SEQ ID NO: 6944 - protein, 10 aa, Artificial Sequence
  Description of Artificial Sequence:  Synthetic Peptide
ASSSPMGVVL

SEQ ID NO: 6945 - protein, 10 aa, Artificial Sequence
  Description of Artificial Sequence:  Synthetic Peptide
TPHTASSSPM

SEQ ID NO: 6946 - protein, 9 aa, Artificial Sequence
  Description of Artificial Sequence:  Synthetic Peptide
VPGMTYNLL

SEQ ID NO: 6947 - protein, 9 aa, Artificial Sequence
  Description of Artificial Sequence:  Synthetic Peptide
VVPGMTYNL

SEQ ID NO: 6948 - protein, 10 aa, Artificial Sequence
  Description of Artificial Sequence:  Synthetic Peptide
VVPGMTYNLL

SEQ ID NO: 6949 - protein, 10 aa, Artificial Sequence
  Description of Artificial Sequence:  Synthetic Peptide
QVVPGMTYNL

SEQ ID NO: 6950 - protein, 9 aa, Artificial Sequence
  Description of Artificial Sequence:  Synthetic Peptide
VPGMTYNLL

SEQ ID NO: 6951 - protein, 9 aa, Artificial Sequence
  Description of Artificial Sequence:  Synthetic Peptide
LLTSSKHRL

SEQ ID NO: 6952 - protein, 10 aa, Artificial Sequence
  Description of Artificial Sequence:  Synthetic Peptide
LLLTSSKHRL

SEQ ID NO: 6953 - protein, 9 aa, Artificial Sequence
  Description of Artificial Sequence:  Synthetic Peptide
RWKNVPSLL

SEQ ID NO: 6954 - protein, 10 aa, Artificial Sequence
  Description of Artificial Sequence:  Synthetic Peptide
MMRWKNVPSL

SEQ ID NO: 6955 - protein, 10 aa, Artificial Sequence
  Description of Artificial Sequence:  Synthetic Peptide
CCKGRANKKL

SEQ ID NO: 6956 - protein, 9 aa, Artificial Sequence
  Description of Artificial Sequence:  Synthetic Peptide
CQAYPFSHV

SEQ ID NO: 6957 - protein, 10 aa, Artificial Sequence
  Description of Artificial Sequence:  Synthetic Peptide
SYLVTLRPGF

SEQ ID NO: 6958 - protein, 9 aa, Artificial Sequence
  Description of Artificial Sequence:  Synthetic Peptide
GTREYGEGM

SEQ ID NO: 6959 - protein, 10 aa, Artificial Sequence
  Description of Artificial Sequence:  Synthetic Peptide
RPRSCPRCQA

SEQ ID NO: 6960 - protein, 9 aa, Artificial Sequence
  Description of Artificial Sequence:  Synthetic Peptide
CPRCQAYPF

SEQ ID NO: 6961 - protein, 9 aa, Artificial Sequence
  Description of Artificial Sequence:  Synthetic Peptide
RSCPRCQAY

SEQ ID NO: 6962 - protein, 9 aa, Artificial Sequence
  Description of Artificial Sequence:  Synthetic Peptide
GTREYGEGM

SEQ ID NO: 6963 - protein, 9 aa, Artificial Sequence
  Description of Artificial Sequence:  Synthetic Peptide
TSGTGSVSY

SEQ ID NO: 6964 - protein, 9 aa, Artificial Sequence
  Description of Artificial Sequence:  Synthetic Peptide
SMNTPLGRV

SEQ ID NO: 6965 - protein, 10 aa, Artificial Sequence
  Description of Artificial Sequence:  Synthetic Peptide
APSPSMNTPL

SEQ ID NO: 6966 - protein, 10 aa, Artificial Sequence
  Description of Artificial Sequence:  Synthetic Peptide
SPRTITRVPC

SEQ ID NO: 6967 - protein, 10 aa, Artificial Sequence
  Description of Artificial Sequence:  Synthetic Peptide
APSPSMNTPL

SEQ ID NO: 6968 - protein, 10 aa, Artificial Sequence
  Description of Artificial Sequence:  Synthetic Peptide
ILITWWGPRT

SEQ ID NO: 6969 - protein, 10 aa, Artificial Sequence
  Description of Artificial Sequence:  Synthetic Peptide
MSRCVGWGIL

SEQ ID NO: 6970 - protein, 10 aa, Artificial Sequence
  Description of Artificial Sequence:  Synthetic Peptide
MSRCVGWGIL

SEQ ID NO: 6971 - protein, 9 aa, Artificial Sequence
  Description of Artificial Sequence:  Synthetic Peptide
MQMGPSFHA

SEQ ID NO: 6972 - protein, 10 aa, Artificial Sequence
  Description of Artificial Sequence:  Synthetic Peptide
MGRMCPRHSL

SEQ ID NO: 6973 - protein, 9 aa, Artificial Sequence
  Description of Artificial Sequence:  Synthetic Peptide
MLTLGPPSV

SEQ ID NO: 6974 - protein, 9 aa, Artificial Sequence
  Description of Artificial Sequence:  Synthetic Peptide
AVLCHTPGL

SEQ ID NO: 6975 - protein, 9 aa, Artificial Sequence
  Description of Artificial Sequence:  Synthetic Peptide
KSRAWFAVL

SEQ ID NO: 6976 - protein, 10 aa, Artificial Sequence
  Description of Artificial Sequence:  Synthetic Peptide
FAVLCHTPGL

SEQ ID NO: 6977 - protein, 9 aa, Artificial Sequence
  Description of Artificial Sequence:  Synthetic Peptide
TPKSRAWFA

SEQ ID NO: 6978 - protein, 9 aa, Artificial Sequence
  Description of Artificial Sequence:  Synthetic Peptide
KSRAWFAVL

SEQ ID NO: 6979 - protein, 10 aa, Artificial Sequence
  Description of Artificial Sequence:  Synthetic Peptide
TPKSRAWFAV

SEQ ID NO: 6980 - protein, 10 aa, Artificial Sequence
  Description of Artificial Sequence:  Synthetic Peptide
ALAASCLPAL

SEQ ID NO: 6981 - protein, 9 aa, Artificial Sequence
  Description of Artificial Sequence:  Synthetic Peptide
AAALAASCL

SEQ ID NO: 6982 - protein, 9 aa, Artificial Sequence
  Description of Artificial Sequence:  Synthetic Peptide
NVVTLNQRL

SEQ ID NO: 6983 - protein, 9 aa, Artificial Sequence
  Description of Artificial Sequence:  Synthetic Peptide
LAASCLPAL

SEQ ID NO: 6984 - protein, 9 aa, Artificial Sequence
  Description of Artificial Sequence:  Synthetic Peptide
NAVIAAAAL

SEQ ID NO: 6985 - protein, 10 aa, Artificial Sequence
  Description of Artificial Sequence:  Synthetic Peptide
NQRLGRQSAL

SEQ ID NO: 6986 - protein, 10 aa, Artificial Sequence
  Description of Artificial Sequence:  Synthetic Peptide
AAAALAASCL

SEQ ID NO: 6987 - protein, 10 aa, Artificial Sequence
  Description of Artificial Sequence:  Synthetic Peptide
ALAASCLPAL

SEQ ID NO: 6988 - protein, 10 aa, Artificial Sequence
  Description of Artificial Sequence:  Synthetic Peptide
NQRLGRQSAL

SEQ ID NO: 6989 - protein, 9 aa, Artificial Sequence
  Description of Artificial Sequence:  Synthetic Peptide
TTRSMPGNL

SEQ ID NO: 6990 - protein, 10 aa, Artificial Sequence
  Description of Artificial Sequence:  Synthetic Peptide
GSFLGTTRSM

SEQ ID NO: 6991 - protein, 9 aa, Artificial Sequence
  Description of Artificial Sequence:  Synthetic Peptide
APPRFSPQL

SEQ ID NO: 6992 - protein, 10 aa, Artificial Sequence
  Description of Artificial Sequence:  Synthetic Peptide
LAPPRFSPQL

SEQ ID NO: 6993 - protein, 9 aa, Artificial Sequence
  Description of Artificial Sequence:  Synthetic Peptide
APPRFSPQL

SEQ ID NO: 6994 - protein, 9 aa, Artificial Sequence
  Description of Artificial Sequence:  Synthetic Peptide
RVDPKSCEY

SEQ ID NO: 6995 - protein, 9 aa, Artificial Sequence
  Description of Artificial Sequence:  Synthetic Peptide
YVGGPANAV

SEQ ID NO: 6996 - protein, 10 aa, Artificial Sequence
  Description of Artificial Sequence:  Synthetic Peptide
RVPCGTSVHL

SEQ ID NO: 6997 - protein, 9 aa, Artificial Sequence
  Description of Artificial Sequence:  Synthetic Peptide
VPCGTSVHL

SEQ ID NO: 6998 - protein, 10 aa, Artificial Sequence
  Description of Artificial Sequence:  Synthetic Peptide
RNRQQQHIVL

SEQ ID NO: 6999 - protein, 10 aa, Artificial Sequence
  Description of Artificial Sequence:  Synthetic Peptide
YVGGPANAVL

SEQ ID NO: 7000 - protein, 10 aa, Artificial Sequence
  Description of Artificial Sequence:  Synthetic Peptide
RVPCGTSVHL

SEQ ID NO: 7001 - protein, 9 aa, Artificial Sequence
  Description of Artificial Sequence:  Synthetic Peptide
VPCGTSVHL

SEQ ID NO: 7002 - protein, 10 aa, Artificial Sequence
  Description of Artificial Sequence:  Synthetic Peptide
CVDEQYRVCK

SEQ ID NO: 7003 - protein, 10 aa, Artificial Sequence
  Description of Artificial Sequence:  Synthetic Peptide
DLWGSPLQHL

SEQ ID NO: 7004 - protein, 10 aa, Artificial Sequence
  Description of Artificial Sequence:  Synthetic Peptide
VCKDLWGSPL

SEQ ID NO: 7005 - protein, 10 aa, Artificial Sequence
  Description of Artificial Sequence:  Synthetic Peptide
DEQYRVCKDL

SEQ ID NO: 7006 - protein, 9 aa, Artificial Sequence
  Description of Artificial Sequence:  Synthetic Peptide
SADNLWFDR

SEQ ID NO: 7007 - protein, 9 aa, Artificial Sequence
  Description of Artificial Sequence:  Synthetic Peptide
LIYTYAPPV

SEQ ID NO: 7008 - protein, 9 aa, Artificial Sequence
  Description of Artificial Sequence:  Synthetic Peptide
RVLYLITMV

SEQ ID NO: 7009 - protein, 9 aa, Artificial Sequence
  Description of Artificial Sequence:  Synthetic Peptide
NLWFDRPVA

SEQ ID NO: 7010 - protein, 10 aa, Artificial Sequence
  Description of Artificial Sequence:  Synthetic Peptide
MLIYTYAPPV

SEQ ID NO: 7011 - protein, 9 aa, Artificial Sequence
  Description of Artificial Sequence:  Synthetic Peptide
RPPAPSACL

SEQ ID NO: 7012 - protein, 10 aa, Artificial Sequence
  Description of Artificial Sequence:  Synthetic Peptide
RPQRSGTTGL

SEQ ID NO: 7013 - protein, 9 aa, Artificial Sequence
  Description of Artificial Sequence:  Synthetic Peptide
RLVPGCILR

SEQ ID NO: 7014 - protein, 9 aa, Artificial Sequence
  Description of Artificial Sequence:  Synthetic Peptide
GLGSQVGVR

SEQ ID NO: 7015 - protein, 10 aa, Artificial Sequence
  Description of Artificial Sequence:  Synthetic Peptide
RLVPGCILRR

SEQ ID NO: 7016 - protein, 10 aa, Artificial Sequence
  Description of Artificial Sequence:  Synthetic Peptide
GLGSQVGVRR

SEQ ID NO: 7017 - protein, 9 aa, Artificial Sequence
  Description of Artificial Sequence:  Synthetic Peptide
APAPRVLYL

SEQ ID NO: 7018 - protein, 9 aa, Artificial Sequence
  Description of Artificial Sequence:  Synthetic Peptide
RPPAPSACL

SEQ ID NO: 7019 - protein, 9 aa, Artificial Sequence
  Description of Artificial Sequence:  Synthetic Peptide
APRVLYLIT

SEQ ID NO: 7020 - protein, 9 aa, Artificial Sequence
  Description of Artificial Sequence:  Synthetic Peptide
QVGVRRPRL

SEQ ID NO: 7021 - protein, 9 aa, Artificial Sequence
  Description of Artificial Sequence:  Synthetic Peptide
VPGCILRRM

SEQ ID NO: 7022 - protein, 10 aa, Artificial Sequence
  Description of Artificial Sequence:  Synthetic Peptide
APRVLYLITM

SEQ ID NO: 7023 - protein, 10 aa, Artificial Sequence
  Description of Artificial Sequence:  Synthetic Peptide
RPQRSGTTGL

SEQ ID NO: 7024 - protein, 10 aa, Artificial Sequence
  Description of Artificial Sequence:  Synthetic Peptide
GLRLVPGCIL

SEQ ID NO: 7025 - protein, 10 aa, Artificial Sequence
  Description of Artificial Sequence:  Synthetic Peptide
GGRTRVCGPL

SEQ ID NO: 7026 - protein, 10 aa, Artificial Sequence
  Description of Artificial Sequence:  Synthetic Peptide
APAPRVLYLI

SEQ ID NO: 7027 - protein, 10 aa, Artificial Sequence
  Description of Artificial Sequence:  Synthetic Peptide
GAPAPRVLYL

SEQ ID NO: 7028 - protein, 9 aa, Artificial Sequence
  Description of Artificial Sequence:  Synthetic Peptide
APAPRVLYL

SEQ ID NO: 7029 - protein, 9 aa, Artificial Sequence
  Description of Artificial Sequence:  Synthetic Peptide
EHRGRAIPL

SEQ ID NO: 7030 - protein, 10 aa, Artificial Sequence
  Description of Artificial Sequence:  Synthetic Peptide
GAPAPRVLYL

SEQ ID NO: 7031 - protein, 9 aa, Artificial Sequence
  Description of Artificial Sequence:  Synthetic Peptide
GPLDDVTDF

SEQ ID NO: 7032 - protein, 9 aa, Artificial Sequence
  Description of Artificial Sequence:  Synthetic Peptide
VPGCILRRM

SEQ ID NO: 7033 - protein, 9 aa, Artificial Sequence
  Description of Artificial Sequence:  Synthetic Peptide
RPPAPSACL

SEQ ID NO: 7034 - protein, 9 aa, Artificial Sequence
  Description of Artificial Sequence:  Synthetic Peptide
APAPRVLYL

SEQ ID NO: 7035 - protein, 9 aa, Artificial Sequence
  Description of Artificial Sequence:  Synthetic Peptide
RSGTTGLRL

SEQ ID NO: 7036 - protein, 10 aa, Artificial Sequence
  Description of Artificial Sequence:  Synthetic Peptide
APRVLYLITM

SEQ ID NO: 7037 - protein, 10 aa, Artificial Sequence
  Description of Artificial Sequence:  Synthetic Peptide
RPQRSGTTGL

SEQ ID NO: 7038 - protein, 10 aa, Artificial Sequence
  Description of Artificial Sequence:  Synthetic Peptide
EARSADNLWF

SEQ ID NO: 7039 - protein, 9 aa, Artificial Sequence
  Description of Artificial Sequence:  Synthetic Peptide
AERPQRSGT

SEQ ID NO: 7040 - protein, 9 aa, Artificial Sequence
  Description of Artificial Sequence:  Synthetic Peptide
GEARSADNL

SEQ ID NO: 7041 - protein, 9 aa, Artificial Sequence
  Description of Artificial Sequence:  Synthetic Peptide
RAIPLWCWF

SEQ ID NO: 7042 - protein, 10 aa, Artificial Sequence
  Description of Artificial Sequence:  Synthetic Peptide
GEARSADNLW

SEQ ID NO: 7043 - protein, 10 aa, Artificial Sequence
  Description of Artificial Sequence:  Synthetic Peptide
AERPQRSGTT

SEQ ID NO: 7044 - protein, 10 aa, Artificial Sequence
  Description of Artificial Sequence:  Synthetic Peptide
RGAPAPRVLY

SEQ ID NO: 7045 - protein, 9 aa, Artificial Sequence
  Description of Artificial Sequence:  Synthetic Peptide
APTVPDLSI

SEQ ID NO: 7046 - protein, 9 aa, Artificial Sequence
  Description of Artificial Sequence:  Synthetic Peptide
RPANSGTIW

SEQ ID NO: 7047 - protein, 10 aa, Artificial Sequence
  Description of Artificial Sequence:  Synthetic Peptide
RARRYLHTGY

SEQ ID NO: 7048 - protein, 10 aa, Artificial Sequence
  Description of Artificial Sequence:  Synthetic Peptide
TPEADSARPY

SEQ ID NO: 7049 - protein, 10 aa, Artificial Sequence
  Description of Artificial Sequence:  Synthetic Peptide
TPEADSARPY

SEQ ID NO: 7050 - protein, 9 aa, Artificial Sequence
  Description of Artificial Sequence:  Synthetic Peptide
PEADSARPY

SEQ ID NO: 7051 - protein, 9 aa, Artificial Sequence
  Description of Artificial Sequence:  Synthetic Peptide
AIQGQSPRL

SEQ ID NO: 7052 - protein, 10 aa, Artificial Sequence
  Description of Artificial Sequence:  Synthetic Peptide
SAIQGQSPRL

SEQ ID NO: 7053 - protein, 10 aa, Artificial Sequence
  Description of Artificial Sequence:  Synthetic Peptide
CSLHRASTGY

SEQ ID NO: 7054 - protein, 10 aa, Artificial Sequence
  Description of Artificial Sequence:  Synthetic Peptide
CSLHRASTGY

SEQ ID NO: 7055 - protein, 9 aa, Artificial Sequence
  Description of Artificial Sequence:  Synthetic Peptide
AESGGVLAT

SEQ ID NO: 7056 - protein, 9 aa, Artificial Sequence
  Description of Artificial Sequence:  Synthetic Peptide
VLATAHVEL

SEQ ID NO: 7057 - protein, 9 aa, Artificial Sequence
  Description of Artificial Sequence:  Synthetic Peptide
GFPYGLHRL

SEQ ID NO: 7058 - protein, 10 aa, Artificial Sequence
  Description of Artificial Sequence:  Synthetic Peptide
QPCRGFPYGL

SEQ ID NO: 7059 - protein, 10 aa, Artificial Sequence
  Description of Artificial Sequence:  Synthetic Peptide
GVLATAHVEL

SEQ ID NO: 7060 - protein, 10 aa, Artificial Sequence
  Description of Artificial Sequence:  Synthetic Peptide
PPHNQPDYVL

SEQ ID NO: 7061 - protein, 9 aa, Artificial Sequence
  Description of Artificial Sequence:  Synthetic Peptide
QPPHNQPDY

SEQ ID NO: 7062 - protein, 10 aa, Artificial Sequence
  Description of Artificial Sequence:  Synthetic Peptide
QPCRGFPYGL

SEQ ID NO: 7063 - protein, 9 aa, Artificial Sequence
  Description of Artificial Sequence:  Synthetic Peptide
AESGGVLAT

SEQ ID NO: 7064 - protein, 10 aa, Artificial Sequence
  Description of Artificial Sequence:  Synthetic Peptide
AESGGVLATA

SEQ ID NO: 7065 - protein, 10 aa, Artificial Sequence
  Description of Artificial Sequence:  Synthetic Peptide
SGEPCITNTL

SEQ ID NO: 7066 - protein, 10 aa, Artificial Sequence
  Description of Artificial Sequence:  Synthetic Peptide
SVRISGEPCI

SEQ ID NO: 7067 - protein, 10 aa, Artificial Sequence
  Description of Artificial Sequence:  Synthetic Peptide
CPRERRGSKS

SEQ ID NO: 7068 - protein, 10 aa, Artificial Sequence
  Description of Artificial Sequence:  Synthetic Peptide
GSKSNSIAEL

SEQ ID NO: 7069 - protein, 10 aa, Artificial Sequence
  Description of Artificial Sequence:  Synthetic Peptide
CPRERRGSKS

SEQ ID NO: 7070 - protein, 9 aa, Artificial Sequence
  Description of Artificial Sequence:  Synthetic Peptide
AELSNRHPI

SEQ ID NO: 7071 - protein, 9 aa, Artificial Sequence
  Description of Artificial Sequence:  Synthetic Peptide
DEQTHSVRI

SEQ ID NO: 7072 - protein, 10 aa, Artificial Sequence
  Description of Artificial Sequence:  Synthetic Peptide
DEQTHSVRIS

SEQ ID NO: 7073 - protein, 10 aa, Artificial Sequence
  Description of Artificial Sequence:  Synthetic Peptide
AELSNRHPIA

SEQ ID NO: 7074 - protein, 10 aa, Artificial Sequence
  Description of Artificial Sequence:  Synthetic Peptide
RLYRTRKEWV

SEQ ID NO: 7075 - protein, 9 aa, Artificial Sequence
  Description of Artificial Sequence:  Synthetic Peptide
NALPLWGRL

SEQ ID NO: 7076 - protein, 9 aa, Artificial Sequence
  Description of Artificial Sequence:  Synthetic Peptide
MSKGVQGSM

SEQ ID NO: 7077 - protein, 10 aa, Artificial Sequence
  Description of Artificial Sequence:  Synthetic Peptide
NALPLWGRLY

SEQ ID NO: 7078 - protein, 9 aa, Artificial Sequence
  Description of Artificial Sequence:  Synthetic Peptide
MPGASARVL

SEQ ID NO: 7079 - protein, 9 aa, Artificial Sequence
  Description of Artificial Sequence:  Synthetic Peptide
EAPPLCSSL

SEQ ID NO: 7080 - protein, 10 aa, Artificial Sequence
  Description of Artificial Sequence:  Synthetic Peptide
RVRRSEAPPL

SEQ ID NO: 7081 - protein, 9 aa, Artificial Sequence
  Description of Artificial Sequence:  Synthetic Peptide
MPGASARVL

SEQ ID NO: 7082 - protein, 9 aa, Artificial Sequence
  Description of Artificial Sequence:  Synthetic Peptide
SEAPPLCSS

SEQ ID NO: 7083 - protein, 10 aa, Artificial Sequence
  Description of Artificial Sequence:  Synthetic Peptide
SEAPPLCSSL

SEQ ID NO: 7084 - protein, 9 aa, Artificial Sequence
  Description of Artificial Sequence:  Synthetic Peptide
APCARFTSI

SEQ ID NO: 7085 - protein, 9 aa, Artificial Sequence
  Description of Artificial Sequence:  Synthetic Peptide
RAGRRSVNL

SEQ ID NO: 7086 - protein, 9 aa, Artificial Sequence
  Description of Artificial Sequence:  Synthetic Peptide
ILLRSRYRI

SEQ ID NO: 7087 - protein, 10 aa, Artificial Sequence
  Description of Artificial Sequence:  Synthetic Peptide
LLRSRYRIHR

SEQ ID NO: 7088 - protein, 9 aa, Artificial Sequence
  Description of Artificial Sequence:  Synthetic Peptide
AARSSRVCL

SEQ ID NO: 7089 - protein, 9 aa, Artificial Sequence
  Description of Artificial Sequence:  Synthetic Peptide
TGRDRHILL

SEQ ID NO: 7090 - protein, 10 aa, Artificial Sequence
  Description of Artificial Sequence:  Synthetic Peptide
RAARSSRVCL

SEQ ID NO: 7091 - protein, 9 aa, Artificial Sequence
  Description of Artificial Sequence:  Synthetic Peptide
TGRDRHILL

SEQ ID NO: 7092 - protein, 9 aa, Artificial Sequence
  Description of Artificial Sequence:  Synthetic Peptide
AARSSRVCL

SEQ ID NO: 7093 - protein, 10 aa, Artificial Sequence
  Description of Artificial Sequence:  Synthetic Peptide
NLRAARSSRV

SEQ ID NO: 7094 - protein, 10 aa, Artificial Sequence
  Description of Artificial Sequence:  Synthetic Peptide
AARSSRVCLA

SEQ ID NO: 7095 - protein, 9 aa, Artificial Sequence
  Description of Artificial Sequence:  Synthetic Peptide
TPCPGREIF

SEQ ID NO: 7096 - protein, 9 aa, Artificial Sequence
  Description of Artificial Sequence:  Synthetic Peptide
REIFPVDET

SEQ ID NO: 7097 - protein, 9 aa, Artificial Sequence
  Description of Artificial Sequence:  Synthetic Peptide
DETGRDRHI

SEQ ID NO: 7098 - protein, 9 aa, Artificial Sequence
  Description of Artificial Sequence:  Synthetic Peptide
MEGPNLRAA

SEQ ID NO: 7099 - protein, 10 aa, Artificial Sequence
  Description of Artificial Sequence:  Synthetic Peptide
LVAETPQSCL

SEQ ID NO: 7100 - protein, 9 aa, Artificial Sequence
  Description of Artificial Sequence:  Synthetic Peptide
LLYVISKRR

SEQ ID NO: 7101 - protein, 9 aa, Artificial Sequence
  Description of Artificial Sequence:  Synthetic Peptide
CLLYVISKR

SEQ ID NO: 7102 - protein, 10 aa, Artificial Sequence
  Description of Artificial Sequence:  Synthetic Peptide
LVAETPQSCL

SEQ ID NO: 7103 - protein, 9 aa, Artificial Sequence
  Description of Artificial Sequence:  Synthetic Peptide
SEEGYLRQT

SEQ ID NO: 7104 - protein, 9 aa, Artificial Sequence
  Description of Artificial Sequence:  Synthetic Peptide
AETPQSCLL

SEQ ID NO: 7105 - protein, 10 aa, Artificial Sequence
  Description of Artificial Sequence:  Synthetic Peptide
AETPQSCLLY

SEQ ID NO: 7106 - protein, 10 aa, Artificial Sequence
  Description of Artificial Sequence:  Synthetic Peptide
SEEGYLRQTA

SEQ ID NO: 7107 - protein, 9 aa, Artificial Sequence
  Description of Artificial Sequence:  Synthetic Peptide
DSRVKATSV

SEQ ID NO: 7108 - protein, 9 aa, Artificial Sequence
  Description of Artificial Sequence:  Synthetic Peptide
MLHSLFGRV

SEQ ID NO: 7109 - protein, 10 aa, Artificial Sequence
  Description of Artificial Sequence:  Synthetic Peptide
VLEPVGRPHR

SEQ ID NO: 7110 - protein, 10 aa, Artificial Sequence
  Description of Artificial Sequence:  Synthetic Peptide
SLFGRVLEPV

SEQ ID NO: 7111 - protein, 10 aa, Artificial Sequence
  Description of Artificial Sequence:  Synthetic Peptide
MLHSLFGRVL

SEQ ID NO: 7112 - protein, 9 aa, Artificial Sequence
  Description of Artificial Sequence:  Synthetic Peptide
MVIEHLQSV

SEQ ID NO: 7113 - protein, 9 aa, Artificial Sequence
  Description of Artificial Sequence:  Synthetic Peptide
QSVEGNLLL

SEQ ID NO: 7114 - protein, 9 aa, Artificial Sequence
  Description of Artificial Sequence:  Synthetic Peptide
RPVRLTSGF

SEQ ID NO: 7115 - protein, 9 aa, Artificial Sequence
  Description of Artificial Sequence:  Synthetic Peptide
GLTRRSIAV

SEQ ID NO: 7116 - protein, 10 aa, Artificial Sequence
  Description of Artificial Sequence:  Synthetic Peptide
YTEGDLVPQK

SEQ ID NO: 7117 - protein, 9 aa, Artificial Sequence
  Description of Artificial Sequence:  Synthetic Peptide
APQGTRVIV

SEQ ID NO: 7118 - protein, 9 aa, Artificial Sequence
  Description of Artificial Sequence:  Synthetic Peptide
YMPAQHCST

SEQ ID NO: 7119 - protein, 9 aa, Artificial Sequence
  Description of Artificial Sequence:  Synthetic Peptide
MPAQHCSTY

SEQ ID NO: 7120 - protein, 10 aa, Artificial Sequence
  Description of Artificial Sequence:  Synthetic Peptide
RYESVHPLHC

SEQ ID NO: 7121 - protein, 10 aa, Artificial Sequence
  Description of Artificial Sequence:  Synthetic Peptide
CERYESVHPL

SEQ ID NO: 7122 - protein, 9 aa, Artificial Sequence
  Description of Artificial Sequence:  Synthetic Peptide
MPHDDDTTY

SEQ ID NO: 7123 - protein, 9 aa, Artificial Sequence
  Description of Artificial Sequence:  Synthetic Peptide
CLIQHRAYT

SEQ ID NO: 7124 - protein, 9 aa, Artificial Sequence
  Description of Artificial Sequence:  Synthetic Peptide
FAIKGDFSV

SEQ ID NO: 7125 - protein, 9 aa, Artificial Sequence
  Description of Artificial Sequence:  Synthetic Peptide
RTTPIGEEL

SEQ ID NO: 7126 - protein, 9 aa, Artificial Sequence
  Description of Artificial Sequence:  Synthetic Peptide
CQWEGFAIK

SEQ ID NO: 7127 - protein, 9 aa, Artificial Sequence
  Description of Artificial Sequence:  Synthetic Peptide
QPHPGCLCL

SEQ ID NO: 7128 - protein, 9 aa, Artificial Sequence
  Description of Artificial Sequence:  Synthetic Peptide
SVTGEAHLL

SEQ ID NO: 7129 - protein, 9 aa, Artificial Sequence
  Description of Artificial Sequence:  Synthetic Peptide
QPHPGCLCL

SEQ ID NO: 7130 - protein, 9 aa, Artificial Sequence
  Description of Artificial Sequence:  Synthetic Peptide
GEELAVCGV

SEQ ID NO: 7131 - protein, 9 aa, Artificial Sequence
  Description of Artificial Sequence:  Synthetic Peptide
AEYKVSSSL

SEQ ID NO: 7132 - protein, 10 aa, Artificial Sequence
  Description of Artificial Sequence:  Synthetic Peptide
TQYGGSVLRV

SEQ ID NO: 7133 - protein, 10 aa, Artificial Sequence
  Description of Artificial Sequence:  Synthetic Peptide
FIADDHVIGA

SEQ ID NO: 7134 - protein, 10 aa, Artificial Sequence
  Description of Artificial Sequence:  Synthetic Peptide
QYRQPHPGCL

SEQ ID NO: 7135 - protein, 10 aa, Artificial Sequence
  Description of Artificial Sequence:  Synthetic Peptide
AYTQYGGSVL

SEQ ID NO: 7136 - protein, 10 aa, Artificial Sequence
  Description of Artificial Sequence:  Synthetic Peptide
DFSVTGEAHL

SEQ ID NO: 7137 - protein, 10 aa, Artificial Sequence
  Description of Artificial Sequence:  Synthetic Peptide
RQPHPGCLCL

SEQ ID NO: 7138 - protein, 10 aa, Artificial Sequence
  Description of Artificial Sequence:  Synthetic Peptide
WEGFAIKGDF

SEQ ID NO: 7139 - protein, 10 aa, Artificial Sequence
  Description of Artificial Sequence:  Synthetic Peptide
TDVGVNPIGF

SEQ ID NO: 7140 - protein, 9 aa, Artificial Sequence
  Description of Artificial Sequence:  Synthetic Peptide
GLGGRGQHL

SEQ ID NO: 7141 - protein, 9 aa, Artificial Sequence
  Description of Artificial Sequence:  Synthetic Peptide
PYCRTQEGL

SEQ ID NO: 7142 - protein, 9 aa, Artificial Sequence
  Description of Artificial Sequence:  Synthetic Peptide
GGRGQHLHL

SEQ ID NO: 7143 - protein, 9 aa, Artificial Sequence
  Description of Artificial Sequence:  Synthetic Peptide
WLLLTAVTI

SEQ ID NO: 7144 - protein, 9 aa, Artificial Sequence
  Description of Artificial Sequence:  Synthetic Peptide
EQWLLLTAV

SEQ ID NO: 7145 - protein, 9 aa, Artificial Sequence
  Description of Artificial Sequence:  Synthetic Peptide
LLTAVTIFK

SEQ ID NO: 7146 - protein, 10 aa, Artificial Sequence
  Description of Artificial Sequence:  Synthetic Peptide
LLTAVTIFKI

SEQ ID NO: 7147 - protein, 10 aa, Artificial Sequence
  Description of Artificial Sequence:  Synthetic Peptide
LLLTAVTIFK

SEQ ID NO: 7148 - protein, 10 aa, Artificial Sequence
  Description of Artificial Sequence:  Synthetic Peptide
AVTIFKITAL

SEQ ID NO: 7149 - protein, 9 aa, Artificial Sequence
  Description of Artificial Sequence:  Synthetic Peptide
SYEHSDLEY

SEQ ID NO: 7150 - protein, 9 aa, Artificial Sequence
  Description of Artificial Sequence:  Synthetic Peptide
KVGLICFNV

SEQ ID NO: 7151 - protein, 9 aa, Artificial Sequence
  Description of Artificial Sequence:  Synthetic Peptide
RIMPQSVRV

SEQ ID NO: 7152 - protein, 9 aa, Artificial Sequence
  Description of Artificial Sequence:  Synthetic Peptide
NVLHPPIDV

SEQ ID NO: 7153 - protein, 9 aa, Artificial Sequence
  Description of Artificial Sequence:  Synthetic Peptide
IMPQSVRVV

SEQ ID NO: 7154 - protein, 9 aa, Artificial Sequence
  Description of Artificial Sequence:  Synthetic Peptide
VLPETIGRA

SEQ ID NO: 7155 - protein, 9 aa, Artificial Sequence
  Description of Artificial Sequence:  Synthetic Peptide
AFKVGLICF

SEQ ID NO: 7156 - protein, 9 aa, Artificial Sequence
  Description of Artificial Sequence:  Synthetic Peptide
VVYQTPWRK

SEQ ID NO: 7157 - protein, 9 aa, Artificial Sequence
  Description of Artificial Sequence:  Synthetic Peptide
VARGSPTSL

SEQ ID NO: 7158 - protein, 9 aa, Artificial Sequence
  Description of Artificial Sequence:  Synthetic Peptide
IGRAFKVGL

SEQ ID NO: 7159 - protein, 9 aa, Artificial Sequence
  Description of Artificial Sequence:  Synthetic Peptide
AGKRGIMVL

SEQ ID NO: 7160 - protein, 9 aa, Artificial Sequence
  Description of Artificial Sequence:  Synthetic Peptide
VARGSPTSL

SEQ ID NO: 7161 - protein, 9 aa, Artificial Sequence
  Description of Artificial Sequence:  Synthetic Peptide
MPQSVRVVY

SEQ ID NO: 7162 - protein, 9 aa, Artificial Sequence
  Description of Artificial Sequence:  Synthetic Peptide
REVHSARIM

SEQ ID NO: 7163 - protein, 9 aa, Artificial Sequence
  Description of Artificial Sequence:  Synthetic Peptide
LEYREVHSA

SEQ ID NO: 7164 - protein, 10 aa, Artificial Sequence
  Description of Artificial Sequence:  Synthetic Peptide
FMSSYEHSDL

SEQ ID NO: 7165 - protein, 10 aa, Artificial Sequence
  Description of Artificial Sequence:  Synthetic Peptide
TIGRAFKVGL

SEQ ID NO: 7166 - protein, 10 aa, Artificial Sequence
  Description of Artificial Sequence:  Synthetic Peptide
EYREVHSARI

SEQ ID NO: 7167 - protein, 10 aa, Artificial Sequence
  Description of Artificial Sequence:  Synthetic Peptide
KVGLICFNVL

SEQ ID NO: 7168 - protein, 10 aa, Artificial Sequence
  Description of Artificial Sequence:  Synthetic Peptide
IMVLPETIGR

SEQ ID NO: 7169 - protein, 10 aa, Artificial Sequence
  Description of Artificial Sequence:  Synthetic Peptide
HPHTSKPPAL

SEQ ID NO: 7170 - protein, 10 aa, Artificial Sequence
  Description of Artificial Sequence:  Synthetic Peptide
AAGKRGIMVL

SEQ ID NO: 7171 - protein, 10 aa, Artificial Sequence
  Description of Artificial Sequence:  Synthetic Peptide
GPAAGKRGIM

SEQ ID NO: 7172 - protein, 10 aa, Artificial Sequence
  Description of Artificial Sequence:  Synthetic Peptide
DVARGSPTSL

SEQ ID NO: 7173 - protein, 10 aa, Artificial Sequence
  Description of Artificial Sequence:  Synthetic Peptide
KVGLICFNVL

SEQ ID NO: 7174 - protein, 10 aa, Artificial Sequence
  Description of Artificial Sequence:  Synthetic Peptide
HPHTSKPPAL

SEQ ID NO: 7175 - protein, 10 aa, Artificial Sequence
  Description of Artificial Sequence:  Synthetic Peptide
GPAAGKRGIM

SEQ ID NO: 7176 - protein, 10 aa, Artificial Sequence
  Description of Artificial Sequence:  Synthetic Peptide
HPHTSKPPAL

SEQ ID NO: 7177 - protein, 10 aa, Artificial Sequence
  Description of Artificial Sequence:  Synthetic Peptide
SSYEHSDLEY

SEQ ID NO: 7178 - protein, 10 aa, Artificial Sequence
  Description of Artificial Sequence:  Synthetic Peptide
VARGSPTSLY

SEQ ID NO: 7179 - protein, 9 aa, Artificial Sequence
  Description of Artificial Sequence:  Synthetic Peptide
SEGSCDAPY

SEQ ID NO: 7180 - protein, 9 aa, Artificial Sequence
  Description of Artificial Sequence:  Synthetic Peptide
DERNVPHEV

SEQ ID NO: 7181 - protein, 10 aa, Artificial Sequence
  Description of Artificial Sequence:  Synthetic Peptide
MSEGSCDAPY

SEQ ID NO: 7182 - protein, 9 aa, Artificial Sequence
  Description of Artificial Sequence:  Synthetic Peptide
KMKSAPSRR

SEQ ID NO: 7183 - protein, 10 aa, Artificial Sequence
  Description of Artificial Sequence:  Synthetic Peptide
KSAPSRRWAV

SEQ ID NO: 7184 - protein, 10 aa, Artificial Sequence
  Description of Artificial Sequence:  Synthetic Peptide
MPRRRLRSKM

SEQ ID NO: 7185 - protein, 10 aa, Artificial Sequence
  Description of Artificial Sequence:  Synthetic Peptide
MPRRRLRSKM

SEQ ID NO: 7186 - protein, 9 aa, Artificial Sequence
  Description of Artificial Sequence:  Synthetic Peptide
RAGDPSPQM

SEQ ID NO: 7187 - protein, 10 aa, Artificial Sequence
  Description of Artificial Sequence:  Synthetic Peptide
RAGDPSPQML

SEQ ID NO: 7188 - protein, 10 aa, Artificial Sequence
  Description of Artificial Sequence:  Synthetic Peptide
RAGDPSPQML

SEQ ID NO: 7189 - protein, 10 aa, Artificial Sequence
  Description of Artificial Sequence:  Synthetic Peptide
RAGDPSPQML

SEQ ID NO: 7190 - protein, 9 aa, Artificial Sequence
  Description of Artificial Sequence:  Synthetic Peptide
LLWRQSRSM

SEQ ID NO: 7191 - protein, 10 aa, Artificial Sequence
  Description of Artificial Sequence:  Synthetic Peptide
LLWRQSRSMT

SEQ ID NO: 7192 - protein, 9 aa, Artificial Sequence
  Description of Artificial Sequence:  Synthetic Peptide
YLLLRRMCL

SEQ ID NO: 7193 - protein, 9 aa, Artificial Sequence
  Description of Artificial Sequence:  Synthetic Peptide
KISLPGQGV

SEQ ID NO: 7194 - protein, 9 aa, Artificial Sequence
  Description of Artificial Sequence:  Synthetic Peptide
CLSLPVSST

SEQ ID NO: 7195 - protein, 9 aa, Artificial Sequence
  Description of Artificial Sequence:  Synthetic Peptide
ILYLLLRRM

SEQ ID NO: 7196 - protein, 9 aa, Artificial Sequence
  Description of Artificial Sequence:  Synthetic Peptide
RTQRWILYL

SEQ ID NO: 7197 - protein, 9 aa, Artificial Sequence
  Description of Artificial Sequence:  Synthetic Peptide
SLPVSSTGK

SEQ ID NO: 7198 - protein, 9 aa, Artificial Sequence
  Description of Artificial Sequence:  Synthetic Peptide
TQRWILYLL

SEQ ID NO: 7199 - protein, 9 aa, Artificial Sequence
  Description of Artificial Sequence:  Synthetic Peptide
LLRRMCLSL

SEQ ID NO: 7200 - protein, 9 aa, Artificial Sequence
  Description of Artificial Sequence:  Synthetic Peptide
TPRPILRQF

SEQ ID NO: 7201 - protein, 10 aa, Artificial Sequence
  Description of Artificial Sequence:  Synthetic Peptide
LLLRRMCLSL

SEQ ID NO: 7202 - protein, 10 aa, Artificial Sequence
  Description of Artificial Sequence:  Synthetic Peptide
SLPGQGVPRT

SEQ ID NO: 7203 - protein, 10 aa, Artificial Sequence
  Description of Artificial Sequence:  Synthetic Peptide
LYLLLRRMCL

SEQ ID NO: 7204 - protein, 10 aa, Artificial Sequence
  Description of Artificial Sequence:  Synthetic Peptide
RTQRWILYLL

SEQ ID NO: 7205 - protein, 10 aa, Artificial Sequence
  Description of Artificial Sequence:  Synthetic Peptide
TQRWILYLLL

SEQ ID NO: 7206 - protein, 10 aa, Artificial Sequence
  Description of Artificial Sequence:  Synthetic Peptide
VPRTHSTHRA

SEQ ID NO: 7207 - protein, 10 aa, Artificial Sequence
  Description of Artificial Sequence:  Synthetic Peptide
ASHRTQRWIL

SEQ ID NO: 7208 - protein, 9 aa, Artificial Sequence
  Description of Artificial Sequence:  Synthetic Peptide
MEVNRAQGA

SEQ ID NO: 7209 - protein, 10 aa, Artificial Sequence
  Description of Artificial Sequence:  Synthetic Peptide
VNRAQGAGPL

SEQ ID NO: 7210 - protein, 9 aa, Artificial Sequence
  Description of Artificial Sequence:  Synthetic Peptide
RVYSAQWCI

SEQ ID NO: 7211 - protein, 9 aa, Artificial Sequence
  Description of Artificial Sequence:  Synthetic Peptide
APRHNCRRS

SEQ ID NO: 7212 - protein, 9 aa, Artificial Sequence
  Description of Artificial Sequence:  Synthetic Peptide
CARGRVYSA

SEQ ID NO: 7213 - protein, 10 aa, Artificial Sequence
  Description of Artificial Sequence:  Synthetic Peptide
RSWPPPRNEY

SEQ ID NO: 7214 - protein, 10 aa, Artificial Sequence
  Description of Artificial Sequence:  Synthetic Peptide
PPRNEYPPPY

SEQ ID NO: 7215 - protein, 10 aa, Artificial Sequence
  Description of Artificial Sequence:  Synthetic Peptide
ASNCARGRVY

SEQ ID NO: 7216 - protein, 9 aa, Artificial Sequence
  Description of Artificial Sequence:  Synthetic Peptide
RERVCLAPW

SEQ ID NO: 7217 - protein, 10 aa, Artificial Sequence
  Description of Artificial Sequence:  Synthetic Peptide
LPRRSRGHSV

SEQ ID NO: 7218 - protein, 10 aa, Artificial Sequence
  Description of Artificial Sequence:  Synthetic Peptide
LPRRSRGHSV

SEQ ID NO: 7219 - protein, 10 aa, Artificial Sequence
  Description of Artificial Sequence:  Synthetic Peptide
LPRRSRGHSV

SEQ ID NO: 7220 - protein, 10 aa, Artificial Sequence
  Description of Artificial Sequence:  Synthetic Peptide
RSRGHSVLVI

SEQ ID NO: 7221 - protein, 9 aa, Artificial Sequence
  Description of Artificial Sequence:  Synthetic Peptide
LQVPLGVWL

SEQ ID NO: 7222 - protein, 10 aa, Artificial Sequence
  Description of Artificial Sequence:  Synthetic Peptide
MLQVPLGVWL

SEQ ID NO: 7223 - protein, 10 aa, Artificial Sequence
  Description of Artificial Sequence:  Synthetic Peptide
VPLGVWLPNL

SEQ ID NO: 7224 - protein, 10 aa, Artificial Sequence
  Description of Artificial Sequence:  Synthetic Peptide
VPLGVWLPNL

SEQ ID NO: 7225 - protein, 9 aa, Artificial Sequence
  Description of Artificial Sequence:  Synthetic Peptide
SLGPAVLPV

SEQ ID NO: 7226 - protein, 9 aa, Artificial Sequence
  Description of Artificial Sequence:  Synthetic Peptide
SMQSLGPAV

SEQ ID NO: 7227 - protein, 9 aa, Artificial Sequence
  Description of Artificial Sequence:  Synthetic Peptide
PLHERRQWL

SEQ ID NO: 7228 - protein, 9 aa, Artificial Sequence
  Description of Artificial Sequence:  Synthetic Peptide
LPVTRSGHL

SEQ ID NO: 7229 - protein, 9 aa, Artificial Sequence
  Description of Artificial Sequence:  Synthetic Peptide
LPVTRSGHL

SEQ ID NO: 7230 - protein, 9 aa, Artificial Sequence
  Description of Artificial Sequence:  Synthetic Peptide
LPVTRSGHL

SEQ ID NO: 7231 - protein, 9 aa, Artificial Sequence
  Description of Artificial Sequence:  Synthetic Peptide
SPLHERRQW

SEQ ID NO: 7232 - protein, 10 aa, Artificial Sequence
  Description of Artificial Sequence:  Synthetic Peptide
SPLHERRQWL

SEQ ID NO: 7233 - protein, 10 aa, Artificial Sequence
  Description of Artificial Sequence:  Synthetic Peptide
SPLHERRQWL

SEQ ID NO: 7234 - protein, 10 aa, Artificial Sequence
  Description of Artificial Sequence:  Synthetic Peptide
LPVTRSGHLY

SEQ ID NO: 7235 - protein, 10 aa, Artificial Sequence
  Description of Artificial Sequence:  Synthetic Peptide
SPLHERRQWL

SEQ ID NO: 7236 - protein, 9 aa, Artificial Sequence
  Description of Artificial Sequence:  Synthetic Peptide
VVGHTRNNL

SEQ ID NO: 7237 - protein, 10 aa, Artificial Sequence
  Description of Artificial Sequence:  Synthetic Peptide
QVVGHTRNNL

SEQ ID NO: 7238 - protein, 9 aa, Artificial Sequence
  Description of Artificial Sequence:  Synthetic Peptide
RFQWGREGI

SEQ ID NO: 7239 - protein, 10 aa, Artificial Sequence
  Description of Artificial Sequence:  Synthetic Peptide
FQWGREGILL

SEQ ID NO: 7240 - protein, 10 aa, Artificial Sequence
  Description of Artificial Sequence:  Synthetic Peptide
RFQWGREGIL

SEQ ID NO: 7241 - protein, 10 aa, Artificial Sequence
  Description of Artificial Sequence:  Synthetic Peptide
IPVQHKRRGL

SEQ ID NO: 7242 - protein, 10 aa, Artificial Sequence
  Description of Artificial Sequence:  Synthetic Peptide
IPVQHKRRGL

SEQ ID NO: 7243 - protein, 10 aa, Artificial Sequence
  Description of Artificial Sequence:  Synthetic Peptide
IPVQHKRRGL

SEQ ID NO: 7244 - protein, 9 aa, Artificial Sequence
  Description of Artificial Sequence:  Synthetic Peptide
RCLRRLLCL

SEQ ID NO: 7245 - protein, 9 aa, Artificial Sequence
  Description of Artificial Sequence:  Synthetic Peptide
RTRCLRRLL

SEQ ID NO: 7246 - protein, 10 aa, Artificial Sequence
  Description of Artificial Sequence:  Synthetic Peptide
ATRTRCLRRL

SEQ ID NO: 7247 - protein, 10 aa, Artificial Sequence
  Description of Artificial Sequence:  Synthetic Peptide
MQPGTRRNPV

SEQ ID NO: 7248 - protein, 10 aa, Artificial Sequence
  Description of Artificial Sequence:  Synthetic Peptide
GTRRNPVVPL

SEQ ID NO: 7249 - protein, 9 aa, Artificial Sequence
  Description of Artificial Sequence:  Synthetic Peptide
RIDVHVLLR

SEQ ID NO: 7250 - protein, 9 aa, Artificial Sequence
  Description of Artificial Sequence:  Synthetic Peptide
LPSSSCRRL

SEQ ID NO: 7251 - protein, 9 aa, Artificial Sequence
  Description of Artificial Sequence:  Synthetic Peptide
RLRIDVHVL

SEQ ID NO: 7252 - protein, 9 aa, Artificial Sequence
  Description of Artificial Sequence:  Synthetic Peptide
VVAHCGHDL

SEQ ID NO: 7253 - protein, 9 aa, Artificial Sequence
  Description of Artificial Sequence:  Synthetic Peptide
MAILASQSL

SEQ ID NO: 7254 - protein, 9 aa, Artificial Sequence
  Description of Artificial Sequence:  Synthetic Peptide
LPSSSCRRL

SEQ ID NO: 7255 - protein, 10 aa, Artificial Sequence
  Description of Artificial Sequence:  Synthetic Peptide
ILASQSLNGA

SEQ ID NO: 7256 - protein, 10 aa, Artificial Sequence
  Description of Artificial Sequence:  Synthetic Peptide
SMAILASQSL

SEQ ID NO: 7257 - protein, 10 aa, Artificial Sequence
  Description of Artificial Sequence:  Synthetic Peptide
RLRIDVHVLL

SEQ ID NO: 7258 - protein, 10 aa, Artificial Sequence
  Description of Artificial Sequence:  Synthetic Peptide
RLRIDVHVLL

SEQ ID NO: 7259 - protein, 10 aa, Artificial Sequence
  Description of Artificial Sequence:  Synthetic Peptide
VVVAHCGHDL

SEQ ID NO: 7260 - protein, 10 aa, Artificial Sequence
  Description of Artificial Sequence:  Synthetic Peptide
ALPSSSCRRL

SEQ ID NO: 7261 - protein, 10 aa, Artificial Sequence
  Description of Artificial Sequence:  Synthetic Peptide
IDVHVLLRTF

SEQ ID NO: 7262 - protein, 9 aa, Artificial Sequence
  Description of Artificial Sequence:  Synthetic Peptide
MVCPHWDHL

SEQ ID NO: 7263 - protein, 9 aa, Artificial Sequence
  Description of Artificial Sequence:  Synthetic Peptide
RPHTQCSCW

SEQ ID NO: 7264 - protein, 10 aa, Artificial Sequence
  Description of Artificial Sequence:  Synthetic Peptide
CCRFRRRARI

SEQ ID NO: 7265 - protein, 10 aa, Artificial Sequence
  Description of Artificial Sequence:  Synthetic Peptide
SARSRRRPHT

SEQ ID NO: 7266 - protein, 9 aa, Artificial Sequence
  Description of Artificial Sequence:  Synthetic Peptide
GLEAARHSY

SEQ ID NO: 7267 - protein, 9 aa, Artificial Sequence
  Description of Artificial Sequence:  Synthetic Peptide
GLEAARHSY

SEQ ID NO: 7268 - protein, 9 aa, Artificial Sequence
  Description of Artificial Sequence:  Synthetic Peptide
MALPEGGGL

SEQ ID NO: 7269 - protein, 10 aa, Artificial Sequence
  Description of Artificial Sequence:  Synthetic Peptide
ALPEGGGLEA

SEQ ID NO: 7270 - protein, 9 aa, Artificial Sequence
  Description of Artificial Sequence:  Synthetic Peptide
ILAFPPWAM

SEQ ID NO: 7271 - protein, 9 aa, Artificial Sequence
  Description of Artificial Sequence:  Synthetic Peptide
AVGNGVSLV

SEQ ID NO: 7272 - protein, 9 aa, Artificial Sequence
  Description of Artificial Sequence:  Synthetic Peptide
LVLVRTAQL

SEQ ID NO: 7273 - protein, 9 aa, Artificial Sequence
  Description of Artificial Sequence:  Synthetic Peptide
RYRPHILAF

SEQ ID NO: 7274 - protein, 9 aa, Artificial Sequence
  Description of Artificial Sequence:  Synthetic Peptide
AFPPWAMSL

SEQ ID NO: 7275 - protein, 9 aa, Artificial Sequence
  Description of Artificial Sequence:  Synthetic Peptide
SFLRAPATL

SEQ ID NO: 7276 - protein, 9 aa, Artificial Sequence
  Description of Artificial Sequence:  Synthetic Peptide
VLVRTAQLK

SEQ ID NO: 7277 - protein, 9 aa, Artificial Sequence
  Description of Artificial Sequence:  Synthetic Peptide
FLRAPATLL

SEQ ID NO: 7278 - protein, 9 aa, Artificial Sequence
  Description of Artificial Sequence:  Synthetic Peptide
LVLVRTAQL

SEQ ID NO: 7279 - protein, 9 aa, Artificial Sequence
  Description of Artificial Sequence:  Synthetic Peptide
APATLLSSV

SEQ ID NO: 7280 - protein, 9 aa, Artificial Sequence
  Description of Artificial Sequence:  Synthetic Peptide
TARARCLHA

SEQ ID NO: 7281 - protein, 10 aa, Artificial Sequence
  Description of Artificial Sequence:  Synthetic Peptide
NQLERSSWPA

SEQ ID NO: 7282 - protein, 10 aa, Artificial Sequence
  Description of Artificial Sequence:  Synthetic Peptide
SLVLVRTAQL

SEQ ID NO: 7283 - protein, 10 aa, Artificial Sequence
  Description of Artificial Sequence:  Synthetic Peptide
SFLRAPATLL

SEQ ID NO: 7284 - protein, 10 aa, Artificial Sequence
  Description of Artificial Sequence:  Synthetic Peptide
VLVRTAQLKR

SEQ ID NO: 7285 - protein, 10 aa, Artificial Sequence
  Description of Artificial Sequence:  Synthetic Peptide
LARTARARCL

SEQ ID NO: 7286 - protein, 10 aa, Artificial Sequence
  Description of Artificial Sequence:  Synthetic Peptide
FPPTPTVNQL

SEQ ID NO: 7287 - protein, 10 aa, Artificial Sequence
  Description of Artificial Sequence:  Synthetic Peptide
WPAVGNGVSL

SEQ ID NO: 7288 - protein, 10 aa, Artificial Sequence
  Description of Artificial Sequence:  Synthetic Peptide
AVGNGVSLVL

SEQ ID NO: 7289 - protein, 10 aa, Artificial Sequence
  Description of Artificial Sequence:  Synthetic Peptide
ARRGGIPSFL

SEQ ID NO: 7290 - protein, 10 aa, Artificial Sequence
  Description of Artificial Sequence:  Synthetic Peptide
LAFPPWAMSL

SEQ ID NO: 7291 - protein, 10 aa, Artificial Sequence
  Description of Artificial Sequence:  Synthetic Peptide
LARTARARCL

SEQ ID NO: 7292 - protein, 10 aa, Artificial Sequence
  Description of Artificial Sequence:  Synthetic Peptide
QLKRYRPHIL

SEQ ID NO: 7293 - protein, 10 aa, Artificial Sequence
  Description of Artificial Sequence:  Synthetic Peptide
FPPTPTVNQL

SEQ ID NO: 7294 - protein, 10 aa, Artificial Sequence
  Description of Artificial Sequence:  Synthetic Peptide
RPHILAFPPW

SEQ ID NO: 7295 - protein, 10 aa, Artificial Sequence
  Description of Artificial Sequence:  Synthetic Peptide
WPAVGNGVSL

SEQ ID NO: 7296 - protein, 9 aa, Artificial Sequence
  Description of Artificial Sequence:  Synthetic Peptide
MIAGKSSGV

SEQ ID NO: 7297 - protein, 9 aa, Artificial Sequence
  Description of Artificial Sequence:  Synthetic Peptide
MMIFPNQEL

SEQ ID NO: 7298 - protein, 9 aa, Artificial Sequence
  Description of Artificial Sequence:  Synthetic Peptide
QELTGVWRA

SEQ ID NO: 7299 - protein, 9 aa, Artificial Sequence
  Description of Artificial Sequence:  Synthetic Peptide
MEKKWVINT

SEQ ID NO: 7300 - protein, 10 aa, Artificial Sequence
  Description of Artificial Sequence:  Synthetic Peptide
NMMIFPNQEL

SEQ ID NO: 7301 - protein, 10 aa, Artificial Sequence
  Description of Artificial Sequence:  Synthetic Peptide
VINTMRTQMV

SEQ ID NO: 7302 - protein, 10 aa, Artificial Sequence
  Description of Artificial Sequence:  Synthetic Peptide
QMVGANMMIF

SEQ ID NO: 7303 - protein, 10 aa, Artificial Sequence
  Description of Artificial Sequence:  Synthetic Peptide
NMMIFPNQEL

SEQ ID NO: 7304 - protein, 10 aa, Artificial Sequence
  Description of Artificial Sequence:  Synthetic Peptide
FPNQELTGVW

SEQ ID NO: 7305 - protein, 10 aa, Artificial Sequence
  Description of Artificial Sequence:  Synthetic Peptide
QELTGVWRAV

SEQ ID NO: 7306 - protein, 9 aa, Artificial Sequence
  Description of Artificial Sequence:  Synthetic Peptide
ALLAAVALM

SEQ ID NO: 7307 - protein, 9 aa, Artificial Sequence
  Description of Artificial Sequence:  Synthetic Peptide
VLSSSTPQL

SEQ ID NO: 7308 - protein, 9 aa, Artificial Sequence
  Description of Artificial Sequence:  Synthetic Peptide
GFLRPAALL

SEQ ID NO: 7309 - protein, 9 aa, Artificial Sequence
  Description of Artificial Sequence:  Synthetic Peptide
AALLAAVAL

SEQ ID NO: 7310 - protein, 9 aa, Artificial Sequence
  Description of Artificial Sequence:  Synthetic Peptide
SVKARRAVL

SEQ ID NO: 7311 - protein, 9 aa, Artificial Sequence
  Description of Artificial Sequence:  Synthetic Peptide
SVKARRAVL

SEQ ID NO: 7312 - protein, 9 aa, Artificial Sequence
  Description of Artificial Sequence:  Synthetic Peptide
SPQTRKDGF

SEQ ID NO: 7313 - protein, 10 aa, Artificial Sequence
  Description of Artificial Sequence:  Synthetic Peptide
SPQTRKDGFL

SEQ ID NO: 7314 - protein, 10 aa, Artificial Sequence
  Description of Artificial Sequence:  Synthetic Peptide
AVLSSSTPQL

SEQ ID NO: 7315 - protein, 10 aa, Artificial Sequence
  Description of Artificial Sequence:  Synthetic Peptide
ASVKARRAVL

SEQ ID NO: 7316 - protein, 10 aa, Artificial Sequence
  Description of Artificial Sequence:  Synthetic Peptide
SPQTRKDGFL

SEQ ID NO: 7317 - protein, 10 aa, Artificial Sequence
  Description of Artificial Sequence:  Synthetic Peptide
SPQTRKDGFL

SEQ ID NO: 7318 - protein, 9 aa, Artificial Sequence
  Description of Artificial Sequence:  Synthetic Peptide
VLMSCSVTV

SEQ ID NO: 7319 - protein, 9 aa, Artificial Sequence
  Description of Artificial Sequence:  Synthetic Peptide
VSYENPKGV

SEQ ID NO: 7320 - protein, 9 aa, Artificial Sequence
  Description of Artificial Sequence:  Synthetic Peptide
MYSRSVRAL

SEQ ID NO: 7321 - protein, 9 aa, Artificial Sequence
  Description of Artificial Sequence:  Synthetic Peptide
SYENPKGVF

SEQ ID NO: 7322 - protein, 9 aa, Artificial Sequence
  Description of Artificial Sequence:  Synthetic Peptide
WYIPSSVLM

SEQ ID NO: 7323 - protein, 9 aa, Artificial Sequence
  Description of Artificial Sequence:  Synthetic Peptide
GVFFDVHIL

SEQ ID NO: 7324 - protein, 9 aa, Artificial Sequence
  Description of Artificial Sequence:  Synthetic Peptide
NPKGVFFDV

SEQ ID NO: 7325 - protein, 9 aa, Artificial Sequence
  Description of Artificial Sequence:  Synthetic Peptide
CSTRCLGEY

SEQ ID NO: 7326 - protein, 9 aa, Artificial Sequence
  Description of Artificial Sequence:  Synthetic Peptide
RSVRALIAF

SEQ ID NO: 7327 - protein, 9 aa, Artificial Sequence
  Description of Artificial Sequence:  Synthetic Peptide
YENPKGVFF

SEQ ID NO: 7328 - protein, 9 aa, Artificial Sequence
  Description of Artificial Sequence:  Synthetic Peptide
VESKQRVSY

SEQ ID NO: 7329 - protein, 10 aa, Artificial Sequence
  Description of Artificial Sequence:  Synthetic Peptide
TVESKQRVSY

SEQ ID NO: 7330 - protein, 10 aa, Artificial Sequence
  Description of Artificial Sequence:  Synthetic Peptide
SVLMSCSVTV

SEQ ID NO: 7331 - protein, 10 aa, Artificial Sequence
  Description of Artificial Sequence:  Synthetic Peptide
SYENPKGVFF

SEQ ID NO: 7332 - protein, 10 aa, Artificial Sequence
  Description of Artificial Sequence:  Synthetic Peptide
MYSRSVRALI

SEQ ID NO: 7333 - protein, 10 aa, Artificial Sequence
  Description of Artificial Sequence:  Synthetic Peptide
KGVFFDVHIL

SEQ ID NO: 7334 - protein, 10 aa, Artificial Sequence
  Description of Artificial Sequence:  Synthetic Peptide
GVFFDVHILR

SEQ ID NO: 7335 - protein, 10 aa, Artificial Sequence
  Description of Artificial Sequence:  Synthetic Peptide
ILRRCSTRCL

SEQ ID NO: 7336 - protein, 10 aa, Artificial Sequence
  Description of Artificial Sequence:  Synthetic Peptide
ASGSRSQHWY

SEQ ID NO: 7337 - protein, 10 aa, Artificial Sequence
  Description of Artificial Sequence:  Synthetic Peptide
VSYENPKGVF

SEQ ID NO: 7338 - protein, 9 aa, Artificial Sequence
  Description of Artificial Sequence:  Synthetic Peptide
SQTERIWFM

SEQ ID NO: 7339 - protein, 9 aa, Artificial Sequence
  Description of Artificial Sequence:  Synthetic Peptide
TLNTSFFAI

SEQ ID NO: 7340 - protein, 9 aa, Artificial Sequence
  Description of Artificial Sequence:  Synthetic Peptide
FTLNTSFFA

SEQ ID NO: 7341 - protein, 9 aa, Artificial Sequence
  Description of Artificial Sequence:  Synthetic Peptide
AIMVVGIGV

SEQ ID NO: 7342 - protein, 9 aa, Artificial Sequence
  Description of Artificial Sequence:  Synthetic Peptide
FTPDARSFT

SEQ ID NO: 7343 - protein, 9 aa, Artificial Sequence
  Description of Artificial Sequence:  Synthetic Peptide
SFTSLSTFL

SEQ ID NO: 7344 - protein, 9 aa, Artificial Sequence
  Description of Artificial Sequence:  Synthetic Peptide
RPPFAGFTL

SEQ ID NO: 7345 - protein, 9 aa, Artificial Sequence
  Description of Artificial Sequence:  Synthetic Peptide
GFTLNTSFF

SEQ ID NO: 7346 - protein, 9 aa, Artificial Sequence
  Description of Artificial Sequence:  Synthetic Peptide
GLRPPFAGF

SEQ ID NO: 7347 - protein, 9 aa, Artificial Sequence
  Description of Artificial Sequence:  Synthetic Peptide
RPPFAGFTL

SEQ ID NO: 7348 - protein, 9 aa, Artificial Sequence
  Description of Artificial Sequence:  Synthetic Peptide
MVVGIGVLL

SEQ ID NO: 7349 - protein, 9 aa, Artificial Sequence
  Description of Artificial Sequence:  Synthetic Peptide
RPPFAGFTL

SEQ ID NO: 7350 - protein, 9 aa, Artificial Sequence
  Description of Artificial Sequence:  Synthetic Peptide
SSKESRRPF

SEQ ID NO: 7351 - protein, 9 aa, Artificial Sequence
  Description of Artificial Sequence:  Synthetic Peptide
YPYFDRPEW

SEQ ID NO: 7352 - protein, 9 aa, Artificial Sequence
  Description of Artificial Sequence:  Synthetic Peptide
RSFTSLSTF

SEQ ID NO: 7353 - protein, 9 aa, Artificial Sequence
  Description of Artificial Sequence:  Synthetic Peptide
KERTSFALY

SEQ ID NO: 7354 - protein, 10 aa, Artificial Sequence
  Description of Artificial Sequence:  Synthetic Peptide
FTLNTSFFAI

SEQ ID NO: 7355 - protein, 10 aa, Artificial Sequence
  Description of Artificial Sequence:  Synthetic Peptide
IMVVGIGVLL

SEQ ID NO: 7356 - protein, 10 aa, Artificial Sequence
  Description of Artificial Sequence:  Synthetic Peptide
SQTERIWFMA

SEQ ID NO: 7357 - protein, 10 aa, Artificial Sequence
  Description of Artificial Sequence:  Synthetic Peptide
LLDKERTSFA

SEQ ID NO: 7358 - protein, 10 aa, Artificial Sequence
  Description of Artificial Sequence:  Synthetic Peptide
TLNTSFFAIM

SEQ ID NO: 7359 - protein, 10 aa, Artificial Sequence
  Description of Artificial Sequence:  Synthetic Peptide
LLSSNKSSQT

SEQ ID NO: 7360 - protein, 10 aa, Artificial Sequence
  Description of Artificial Sequence:  Synthetic Peptide
FMALLDKERT

SEQ ID NO: 7361 - protein, 10 aa, Artificial Sequence
  Description of Artificial Sequence:  Synthetic Peptide
RIWFMALLDK

SEQ ID NO: 7362 - protein, 10 aa, Artificial Sequence
  Description of Artificial Sequence:  Synthetic Peptide
AIMVVGIGVL

SEQ ID NO: 7363 - protein, 10 aa, Artificial Sequence
  Description of Artificial Sequence:  Synthetic Peptide
TPDARSFTSL

SEQ ID NO: 7364 - protein, 10 aa, Artificial Sequence
  Description of Artificial Sequence:  Synthetic Peptide
RPFTPDARSF

SEQ ID NO: 7365 - protein, 10 aa, Artificial Sequence
  Description of Artificial Sequence:  Synthetic Peptide
KSSQTERIWF

SEQ ID NO: 7366 - protein, 10 aa, Artificial Sequence
  Description of Artificial Sequence:  Synthetic Peptide
SSQTERIWFM

SEQ ID NO: 7367 - protein, 10 aa, Artificial Sequence
  Description of Artificial Sequence:  Synthetic Peptide
RSFTSLSTFL

SEQ ID NO: 7368 - protein, 9 aa, Artificial Sequence
  Description of Artificial Sequence:  Synthetic Peptide
TVDQESASR

SEQ ID NO: 7369 - protein, 9 aa, Artificial Sequence
  Description of Artificial Sequence:  Synthetic Peptide
DPSSLIVLF

SEQ ID NO: 7370 - protein, 9 aa, Artificial Sequence
  Description of Artificial Sequence:  Synthetic Peptide
RARSAADTF

SEQ ID NO: 7371 - protein, 9 aa, Artificial Sequence
  Description of Artificial Sequence:  Synthetic Peptide
EDVPVPSGF

SEQ ID NO: 7372 - protein, 9 aa, Artificial Sequence
  Description of Artificial Sequence:  Synthetic Peptide
DEYDSTSDS

SEQ ID NO: 7373 - protein, 10 aa, Artificial Sequence
  Description of Artificial Sequence:  Synthetic Peptide
TLCSSESLTV

SEQ ID NO: 7374 - protein, 10 aa, Artificial Sequence
  Description of Artificial Sequence:  Synthetic Peptide
EYDIEQQTTL

SEQ ID NO: 7375 - protein, 10 aa, Artificial Sequence
  Description of Artificial Sequence:  Synthetic Peptide
TFDPSSLIVL

SEQ ID NO: 7376 - protein, 10 aa, Artificial Sequence
  Description of Artificial Sequence:  Synthetic Peptide
DPSSLIVLFL

SEQ ID NO: 7377 - protein, 10 aa, Artificial Sequence
  Description of Artificial Sequence:  Synthetic Peptide
SPGSPSRGGM

SEQ ID NO: 7378 - protein, 10 aa, Artificial Sequence
  Description of Artificial Sequence:  Synthetic Peptide
AADTFDPSSL

SEQ ID NO: 7379 - protein, 10 aa, Artificial Sequence
  Description of Artificial Sequence:  Synthetic Peptide
SPGSPSRGGM

SEQ ID NO: 7380 - protein, 10 aa, Artificial Sequence
  Description of Artificial Sequence:  Synthetic Peptide
SPSRGGMDEY

SEQ ID NO: 7381 - protein, 10 aa, Artificial Sequence
  Description of Artificial Sequence:  Synthetic Peptide
DPSSLIVLFL

SEQ ID NO: 7382 - protein, 10 aa, Artificial Sequence
  Description of Artificial Sequence:  Synthetic Peptide
EEDVPVPSGF

SEQ ID NO: 7383 - protein, 10 aa, Artificial Sequence
  Description of Artificial Sequence:  Synthetic Peptide
SESLTVDQES

SEQ ID NO: 7384 - protein, 10 aa, Artificial Sequence
  Description of Artificial Sequence:  Synthetic Peptide
DEYDSTSDSS

SEQ ID NO: 7385 - protein, 10 aa, Artificial Sequence
  Description of Artificial Sequence:  Synthetic Peptide
GESPDSAVDS

SEQ ID NO: 7386 - protein, 9 aa, Artificial Sequence
  Description of Artificial Sequence:  Synthetic Peptide
ILMDPFLTC

SEQ ID NO: 7387 - protein, 9 aa, Artificial Sequence
  Description of Artificial Sequence:  Synthetic Peptide
AILMDPFLT

SEQ ID NO: 7388 - protein, 9 aa, Artificial Sequence
  Description of Artificial Sequence:  Synthetic Peptide
AQRPDPAIL

SEQ ID NO: 7389 - protein, 9 aa, Artificial Sequence
  Description of Artificial Sequence:  Synthetic Peptide
TPSPRHTPL

SEQ ID NO: 7390 - protein, 9 aa, Artificial Sequence
  Description of Artificial Sequence:  Synthetic Peptide
SPQGQRVVI

SEQ ID NO: 7391 - protein, 9 aa, Artificial Sequence
  Description of Artificial Sequence:  Synthetic Peptide
TPSPRHTPL

SEQ ID NO: 7392 - protein, 9 aa, Artificial Sequence
  Description of Artificial Sequence:  Synthetic Peptide
DPAILMDPF

SEQ ID NO: 7393 - protein, 9 aa, Artificial Sequence
  Description of Artificial Sequence:  Synthetic Peptide
TPSPRHTPL

SEQ ID NO: 7394 - protein, 10 aa, Artificial Sequence
  Description of Artificial Sequence:  Synthetic Peptide
LMDPFLTCPV

SEQ ID NO: 7395 - protein, 10 aa, Artificial Sequence
  Description of Artificial Sequence:  Synthetic Peptide
MLAQRPDPAI

SEQ ID NO: 7396 - protein, 10 aa, Artificial Sequence
  Description of Artificial Sequence:  Synthetic Peptide
DPAILMDPFL

SEQ ID NO: 7397 - protein, 10 aa, Artificial Sequence
  Description of Artificial Sequence:  Synthetic Peptide
AQRPDPAILM

SEQ ID NO: 7398 - protein, 10 aa, Artificial Sequence
  Description of Artificial Sequence:  Synthetic Peptide
LAQRPDPAIL

SEQ ID NO: 7399 - protein, 10 aa, Artificial Sequence
  Description of Artificial Sequence:  Synthetic Peptide
SPRHTPLYPF

SEQ ID NO: 7400 - protein, 10 aa, Artificial Sequence
  Description of Artificial Sequence:  Synthetic Peptide
TPSPRHTPLY

SEQ ID NO: 7401 - protein, 10 aa, Artificial Sequence
  Description of Artificial Sequence:  Synthetic Peptide
DPAILMDPFL

SEQ ID NO: 7402 - protein, 9 aa, Artificial Sequence
  Description of Artificial Sequence:  Synthetic Peptide
GMILAESQV

SEQ ID NO: 7403 - protein, 9 aa, Artificial Sequence
  Description of Artificial Sequence:  Synthetic Peptide
QMSCNQSPL

SEQ ID NO: 7404 - protein, 9 aa, Artificial Sequence
  Description of Artificial Sequence:  Synthetic Peptide
ILAESQVLK

SEQ ID NO: 7405 - protein, 9 aa, Artificial Sequence
  Description of Artificial Sequence:  Synthetic Peptide
MPGTLGMIL

SEQ ID NO: 7406 - protein, 9 aa, Artificial Sequence
  Description of Artificial Sequence:  Synthetic Peptide
MPGTLGMIL

SEQ ID NO: 7407 - protein, 9 aa, Artificial Sequence
  Description of Artificial Sequence:  Synthetic Peptide
AESQVLKSL

SEQ ID NO: 7408 - protein, 10 aa, Artificial Sequence
  Description of Artificial Sequence:  Synthetic Peptide
SQMSCNQSPL

SEQ ID NO: 7409 - protein, 10 aa, Artificial Sequence
  Description of Artificial Sequence:  Synthetic Peptide
LSTIQTQSQM

SEQ ID NO: 7410 - protein, 9 aa, Artificial Sequence
  Description of Artificial Sequence:  Synthetic Peptide
VTEAVKAIR

SEQ ID NO: 7411 - protein, 9 aa, Artificial Sequence
  Description of Artificial Sequence:  Synthetic Peptide
ATQPPRMLK

SEQ ID NO: 7412 - protein, 9 aa, Artificial Sequence
  Description of Artificial Sequence:  Synthetic Peptide
GSSPPMILK

SEQ ID NO: 7413 - protein, 9 aa, Artificial Sequence
  Description of Artificial Sequence:  Synthetic Peptide
RMLKNIVWL

SEQ ID NO: 7414 - protein, 9 aa, Artificial Sequence
  Description of Artificial Sequence:  Synthetic Peptide
MLKNIVWLV

SEQ ID NO: 7415 - protein, 9 aa, Artificial Sequence
  Description of Artificial Sequence:  Synthetic Peptide
WIPLTKFHM

SEQ ID NO: 7416 - protein, 9 aa, Artificial Sequence
  Description of Artificial Sequence:  Synthetic Peptide
TLPMPMPPT

SEQ ID NO: 7417 - protein, 9 aa, Artificial Sequence
  Description of Artificial Sequence:  Synthetic Peptide
LVTEAVKAI

SEQ ID NO: 7418 - protein, 9 aa, Artificial Sequence
  Description of Artificial Sequence:  Synthetic Peptide
WLVVRGLVT

SEQ ID NO: 7419 - protein, 9 aa, Artificial Sequence
  Description of Artificial Sequence:  Synthetic Peptide
KMAGRRLTM

SEQ ID NO: 7420 - protein, 9 aa, Artificial Sequence
  Description of Artificial Sequence:  Synthetic Peptide
IVWLVVRGL

SEQ ID NO: 7421 - protein, 9 aa, Artificial Sequence
  Description of Artificial Sequence:  Synthetic Peptide
RYWIPLTKF

SEQ ID NO: 7422 - protein, 9 aa, Artificial Sequence
  Description of Artificial Sequence:  Synthetic Peptide
RMLKNIVWL

SEQ ID NO: 7423 - protein, 9 aa, Artificial Sequence
  Description of Artificial Sequence:  Synthetic Peptide
AIREATAGL

SEQ ID NO: 7424 - protein, 9 aa, Artificial Sequence
  Description of Artificial Sequence:  Synthetic Peptide
RPARYWIPL

SEQ ID NO: 7425 - protein, 9 aa, Artificial Sequence
  Description of Artificial Sequence:  Synthetic Peptide
KPRTLSLNC

SEQ ID NO: 7426 - protein, 9 aa, Artificial Sequence
  Description of Artificial Sequence:  Synthetic Peptide
IVWLVVRGL

SEQ ID NO: 7427 - protein, 9 aa, Artificial Sequence
  Description of Artificial Sequence:  Synthetic Peptide
VATQPPRML

SEQ ID NO: 7428 - protein, 9 aa, Artificial Sequence
  Description of Artificial Sequence:  Synthetic Peptide
ALCSKPRTL

SEQ ID NO: 7429 - protein, 9 aa, Artificial Sequence
  Description of Artificial Sequence:  Synthetic Peptide
CSKPRTLSL

SEQ ID NO: 7430 - protein, 9 aa, Artificial Sequence
  Description of Artificial Sequence:  Synthetic Peptide
RPARYWIPL

SEQ ID NO: 7431 - protein, 9 aa, Artificial Sequence
  Description of Artificial Sequence:  Synthetic Peptide
RAPETPAPY

SEQ ID NO: 7432 - protein, 9 aa, Artificial Sequence
  Description of Artificial Sequence:  Synthetic Peptide
GSVERPARY

SEQ ID NO: 7433 - protein, 9 aa, Artificial Sequence
  Description of Artificial Sequence:  Synthetic Peptide
CSKPRTLSL

SEQ ID NO: 7434 - protein, 9 aa, Artificial Sequence
  Description of Artificial Sequence:  Synthetic Peptide
KPRTLSLNC

SEQ ID NO: 7435 - protein, 9 aa, Artificial Sequence
  Description of Artificial Sequence:  Synthetic Peptide
SSNTLPMPM

SEQ ID NO: 7436 - protein, 9 aa, Artificial Sequence
  Description of Artificial Sequence:  Synthetic Peptide
VERPARYWI

SEQ ID NO: 7437 - protein, 10 aa, Artificial Sequence
  Description of Artificial Sequence:  Synthetic Peptide
NAEDAAGPAR

SEQ ID NO: 7438 - protein, 10 aa, Artificial Sequence
  Description of Artificial Sequence:  Synthetic Peptide
RMLKNIVWLV

SEQ ID NO: 7439 - protein, 10 aa, Artificial Sequence
  Description of Artificial Sequence:  Synthetic Peptide
WLALCSKPRT

SEQ ID NO: 7440 - protein, 10 aa, Artificial Sequence
  Description of Artificial Sequence:  Synthetic Peptide
GLVTEAVKAI

SEQ ID NO: 7441 - protein, 10 aa, Artificial Sequence
  Description of Artificial Sequence:  Synthetic Peptide
IVWLVVRGLV

SEQ ID NO: 7442 - protein, 10 aa, Artificial Sequence
  Description of Artificial Sequence:  Synthetic Peptide
KAIREATAGL

SEQ ID NO: 7443 - protein, 10 aa, Artificial Sequence
  Description of Artificial Sequence:  Synthetic Peptide
YPASTSSNTL

SEQ ID NO: 7444 - protein, 10 aa, Artificial Sequence
  Description of Artificial Sequence:  Synthetic Peptide
MGRISASCWL

SEQ ID NO: 7445 - protein, 10 aa, Artificial Sequence
  Description of Artificial Sequence:  Synthetic Peptide
VVGSSPPMIL

SEQ ID NO: 7446 - protein, 10 aa, Artificial Sequence
  Description of Artificial Sequence:  Synthetic Peptide
CVATQPPRML

SEQ ID NO: 7447 - protein, 10 aa, Artificial Sequence
  Description of Artificial Sequence:  Synthetic Peptide
LALCSKPRTL

SEQ ID NO: 7448 - protein, 10 aa, Artificial Sequence
  Description of Artificial Sequence:  Synthetic Peptide
KAIREATAGL

SEQ ID NO: 7449 - protein, 10 aa, Artificial Sequence
  Description of Artificial Sequence:  Synthetic Peptide
PPTAAPAKPL

SEQ ID NO: 7450 - protein, 10 aa, Artificial Sequence
  Description of Artificial Sequence:  Synthetic Peptide
VVRGLVTEAV

SEQ ID NO: 7451 - protein, 10 aa, Artificial Sequence
  Description of Artificial Sequence:  Synthetic Peptide
LALCSKPRTL

SEQ ID NO: 7452 - protein, 10 aa, Artificial Sequence
  Description of Artificial Sequence:  Synthetic Peptide
LCSKPRTLSL

SEQ ID NO: 7453 - protein, 10 aa, Artificial Sequence
  Description of Artificial Sequence:  Synthetic Peptide
YPASTSSNTL

SEQ ID NO: 7454 - protein, 10 aa, Artificial Sequence
  Description of Artificial Sequence:  Synthetic Peptide
SSVVGSSPPM

SEQ ID NO: 7455 - protein, 10 aa, Artificial Sequence
  Description of Artificial Sequence:  Synthetic Peptide
ASTSSNTLPM

SEQ ID NO: 7456 - protein, 10 aa, Artificial Sequence
  Description of Artificial Sequence:  Synthetic Peptide
TSSNTLPMPM

SEQ ID NO: 7457 - protein, 10 aa, Artificial Sequence
  Description of Artificial Sequence:  Synthetic Peptide
REATAGLPGS

SEQ ID NO: 7458 - protein, 10 aa, Artificial Sequence
  Description of Artificial Sequence:  Synthetic Peptide
TEAVKAIREA

SEQ ID NO: 7459 - protein, 9 aa, Artificial Sequence
  Description of Artificial Sequence:  Synthetic Peptide
MMYLVIGCV

SEQ ID NO: 7460 - protein, 9 aa, Artificial Sequence
  Description of Artificial Sequence:  Synthetic Peptide
AMMYLVIGC

SEQ ID NO: 7461 - protein, 9 aa, Artificial Sequence
  Description of Artificial Sequence:  Synthetic Peptide
MYLVIGCVM

SEQ ID NO: 7462 - protein, 10 aa, Artificial Sequence
  Description of Artificial Sequence:  Synthetic Peptide
AMMYLVIGCV

SEQ ID NO: 7463 - protein, 10 aa, Artificial Sequence
  Description of Artificial Sequence:  Synthetic Peptide
YLVIGCVMQM

SEQ ID NO: 7464 - protein, 10 aa, Artificial Sequence
  Description of Artificial Sequence:  Synthetic Peptide
GLAFARAQTV

SEQ ID NO: 7465 - protein, 9 aa, Artificial Sequence
  Description of Artificial Sequence:  Synthetic Peptide
RSPGVTNRY

SEQ ID NO: 7466 - protein, 9 aa, Artificial Sequence
  Description of Artificial Sequence:  Synthetic Peptide
RSPGVTNRY

SEQ ID NO: 7467 - protein, 10 aa, Artificial Sequence
  Description of Artificial Sequence:  Synthetic Peptide
RYIPGLPRPV

SEQ ID NO: 7468 - protein, 10 aa, Artificial Sequence
  Description of Artificial Sequence:  Synthetic Peptide
GLPRPVRPLR

SEQ ID NO: 7469 - protein, 10 aa, Artificial Sequence
  Description of Artificial Sequence:  Synthetic Peptide
GVTNRYIPGL

SEQ ID NO: 7470 - protein, 9 aa, Artificial Sequence
  Description of Artificial Sequence:  Synthetic Peptide
TLQSITVSK

SEQ ID NO: 7471 - protein, 10 aa, Artificial Sequence
  Description of Artificial Sequence:  Synthetic Peptide
TVSKSPVYPV

SEQ ID NO: 7472 - protein, 10 aa, Artificial Sequence
  Description of Artificial Sequence:  Synthetic Peptide
VSKSPVYPVM

SEQ ID NO: 7473 - protein, 10 aa, Artificial Sequence
  Description of Artificial Sequence:  Synthetic Peptide
KSTYCSTATL

SEQ ID NO: 7474 - protein, 9 aa, Artificial Sequence
  Description of Artificial Sequence:  Synthetic Peptide
VAVASTVSL

SEQ ID NO: 7475 - protein, 10 aa, Artificial Sequence
  Description of Artificial Sequence:  Synthetic Peptide
GVAVASTVSL

SEQ ID NO: 7476 - protein, 9 aa, Artificial Sequence
  Description of Artificial Sequence:  Synthetic Peptide
MVRVPVRML

SEQ ID NO: 7477 - protein, 9 aa, Artificial Sequence
  Description of Artificial Sequence:  Synthetic Peptide
VPKPRVAAT

SEQ ID NO: 7478 - protein, 9 aa, Artificial Sequence
  Description of Artificial Sequence:  Synthetic Peptide
DGFSTRTEY

SEQ ID NO: 7479 - protein, 10 aa, Artificial Sequence
  Description of Artificial Sequence:  Synthetic Peptide
KPRVAATDGF

SEQ ID NO: 7480 - protein, 10 aa, Artificial Sequence
  Description of Artificial Sequence:  Synthetic Peptide
TDGFSTRTEY

SEQ ID NO: 7481 - protein, 9 aa, Artificial Sequence
  Description of Artificial Sequence:  Synthetic Peptide
GLVLSKLAV

SEQ ID NO: 7482 - protein, 9 aa, Artificial Sequence
  Description of Artificial Sequence:  Synthetic Peptide
RYRSEEPHV

SEQ ID NO: 7483 - protein, 9 aa, Artificial Sequence
  Description of Artificial Sequence:  Synthetic Peptide
KLAVESPLR

SEQ ID NO: 7484 - protein, 9 aa, Artificial Sequence
  Description of Artificial Sequence:  Synthetic Peptide
EPLRQDSGL

SEQ ID NO: 7485 - protein, 9 aa, Artificial Sequence
  Description of Artificial Sequence:  Synthetic Peptide
TPLVHTAAL

SEQ ID NO: 7486 - protein, 9 aa, Artificial Sequence
  Description of Artificial Sequence:  Synthetic Peptide
QPTRSWSTL

SEQ ID NO: 7487 - protein, 9 aa, Artificial Sequence
  Description of Artificial Sequence:  Synthetic Peptide
NCRAFATPL

SEQ ID NO: 7488 - protein, 9 aa, Artificial Sequence
  Description of Artificial Sequence:  Synthetic Peptide
NCRAFATPL

SEQ ID NO: 7489 - protein, 9 aa, Artificial Sequence
  Description of Artificial Sequence:  Synthetic Peptide
TPLVHTAAL

SEQ ID NO: 7490 - protein, 9 aa, Artificial Sequence
  Description of Artificial Sequence:  Synthetic Peptide
EPLRQDSGL

SEQ ID NO: 7491 - protein, 9 aa, Artificial Sequence
  Description of Artificial Sequence:  Synthetic Peptide
QPTRSWSTL

SEQ ID NO: 7492 - protein, 9 aa, Artificial Sequence
  Description of Artificial Sequence:  Synthetic Peptide
TSASRVTRY

SEQ ID NO: 7493 - protein, 9 aa, Artificial Sequence
  Description of Artificial Sequence:  Synthetic Peptide
SEEPHVQGS

SEQ ID NO: 7494 - protein, 9 aa, Artificial Sequence
  Description of Artificial Sequence:  Synthetic Peptide
TSASRVTRY

SEQ ID NO: 7495 - protein, 10 aa, Artificial Sequence
  Description of Artificial Sequence:  Synthetic Peptide
KLAVESPLRR

SEQ ID NO: 7496 - protein, 10 aa, Artificial Sequence
  Description of Artificial Sequence:  Synthetic Peptide
EPHVQGSRDL

SEQ ID NO: 7497 - protein, 10 aa, Artificial Sequence
  Description of Artificial Sequence:  Synthetic Peptide
IPTTCPEGHM

SEQ ID NO: 7498 - protein, 10 aa, Artificial Sequence
  Description of Artificial Sequence:  Synthetic Peptide
ATPLVHTAAL

SEQ ID NO: 7499 - protein, 10 aa, Artificial Sequence
  Description of Artificial Sequence:  Synthetic Peptide
IPTTCPEGHM

SEQ ID NO: 7500 - protein, 10 aa, Artificial Sequence
  Description of Artificial Sequence:  Synthetic Peptide
EPHVQGSRDL

SEQ ID NO: 7501 - protein, 10 aa, Artificial Sequence
  Description of Artificial Sequence:  Synthetic Peptide
LSKLAVESPL

SEQ ID NO: 7502 - protein, 10 aa, Artificial Sequence
  Description of Artificial Sequence:  Synthetic Peptide
RTSASRVTRY

SEQ ID NO: 7503 - protein, 9 aa, Artificial Sequence
  Description of Artificial Sequence:  Synthetic Peptide
MTPPTVVPK

SEQ ID NO: 7504 - protein, 9 aa, Artificial Sequence
  Description of Artificial Sequence:  Synthetic Peptide
FLSLPVRLV

SEQ ID NO: 7505 - protein, 9 aa, Artificial Sequence
  Description of Artificial Sequence:  Synthetic Peptide
TVVPKKVWV

SEQ ID NO: 7506 - protein, 9 aa, Artificial Sequence
  Description of Artificial Sequence:  Synthetic Peptide
SLPVRLVTI

SEQ ID NO: 7507 - protein, 9 aa, Artificial Sequence
  Description of Artificial Sequence:  Synthetic Peptide
KVWVAVDST

SEQ ID NO: 7508 - protein, 9 aa, Artificial Sequence
  Description of Artificial Sequence:  Synthetic Peptide
TFLSLPVRL

SEQ ID NO: 7509 - protein, 9 aa, Artificial Sequence
  Description of Artificial Sequence:  Synthetic Peptide
SPVTTFLSL

SEQ ID NO: 7510 - protein, 9 aa, Artificial Sequence
  Description of Artificial Sequence:  Synthetic Peptide
DSRRHPIFL

SEQ ID NO: 7511 - protein, 9 aa, Artificial Sequence
  Description of Artificial Sequence:  Synthetic Peptide
SPRVCWAYA

SEQ ID NO: 7512 - protein, 9 aa, Artificial Sequence
  Description of Artificial Sequence:  Synthetic Peptide
SPVTTFLSL

SEQ ID NO: 7513 - protein, 9 aa, Artificial Sequence
  Description of Artificial Sequence:  Synthetic Peptide
DSRRHPIFL

SEQ ID NO: 7514 - protein, 9 aa, Artificial Sequence
  Description of Artificial Sequence:  Synthetic Peptide
VPKKVWVAV

SEQ ID NO: 7515 - protein, 9 aa, Artificial Sequence
  Description of Artificial Sequence:  Synthetic Peptide
NSPRVCWAY

SEQ ID NO: 7516 - protein, 9 aa, Artificial Sequence
  Description of Artificial Sequence:  Synthetic Peptide
VPNSPRVCW

SEQ ID NO: 7517 - protein, 10 aa, Artificial Sequence
  Description of Artificial Sequence:  Synthetic Peptide
MTPPTVVPKK

SEQ ID NO: 7518 - protein, 10 aa, Artificial Sequence
  Description of Artificial Sequence:  Synthetic Peptide
SLPVRLVTIV

SEQ ID NO: 7519 - protein, 10 aa, Artificial Sequence
  Description of Artificial Sequence:  Synthetic Peptide
VVPKKVWVAV

SEQ ID NO: 7520 - protein, 10 aa, Artificial Sequence
  Description of Artificial Sequence:  Synthetic Peptide
FLSLPVRLVT

SEQ ID NO: 7521 - protein, 10 aa, Artificial Sequence
  Description of Artificial Sequence:  Synthetic Peptide
KVWVAVDSTC

SEQ ID NO: 7522 - protein, 9 aa, Artificial Sequence
  Description of Artificial Sequence:  Synthetic Peptide
KMTGSVATA

SEQ ID NO: 7523 - protein, 9 aa, Artificial Sequence
  Description of Artificial Sequence:  Synthetic Peptide
RPSAAQSCM

SEQ ID NO: 7524 - protein, 9 aa, Artificial Sequence
  Description of Artificial Sequence:  Synthetic Peptide
RPSAAQSCM

SEQ ID NO: 7525 - protein, 9 aa, Artificial Sequence
  Description of Artificial Sequence:  Synthetic Peptide
SCMGDRWSY

SEQ ID NO: 7526 - protein, 10 aa, Artificial Sequence
  Description of Artificial Sequence:  Synthetic Peptide
TLISIGLKMT

SEQ ID NO: 7527 - protein, 10 aa, Artificial Sequence
  Description of Artificial Sequence:  Synthetic Peptide
AVSAPQVITL

SEQ ID NO: 7528 - protein, 10 aa, Artificial Sequence
  Description of Artificial Sequence:  Synthetic Peptide
APQVITLISI

SEQ ID NO: 7529 - protein, 10 aa, Artificial Sequence
  Description of Artificial Sequence:  Synthetic Peptide
QVITLISIGL

SEQ ID NO: 7530 - protein, 10 aa, Artificial Sequence
  Description of Artificial Sequence:  Synthetic Peptide
QSCMGDRWSY

SEQ ID NO: 7531 - protein, 9 aa, Artificial Sequence
  Description of Artificial Sequence:  Synthetic Peptide
AASPLHMAY

SEQ ID NO: 7532 - protein, 9 aa, Artificial Sequence
  Description of Artificial Sequence:  Synthetic Peptide
GYSRLASKI

SEQ ID NO: 7533 - protein, 9 aa, Artificial Sequence
  Description of Artificial Sequence:  Synthetic Peptide
CLYHGDKVK

SEQ ID NO: 7534 - protein, 9 aa, Artificial Sequence
  Description of Artificial Sequence:  Synthetic Peptide
QIRRPIQCL

SEQ ID NO: 7535 - protein, 9 aa, Artificial Sequence
  Description of Artificial Sequence:  Synthetic Peptide
KIREGYSRL

SEQ ID NO: 7536 - protein, 9 aa, Artificial Sequence
  Description of Artificial Sequence:  Synthetic Peptide
LPRTSRGGT

SEQ ID NO: 7537 - protein, 9 aa, Artificial Sequence
  Description of Artificial Sequence:  Synthetic Peptide
NPRSRSTPA

SEQ ID NO: 7538 - protein, 9 aa, Artificial Sequence
  Description of Artificial Sequence:  Synthetic Peptide
ASKITLSRL

SEQ ID NO: 7539 - protein, 9 aa, Artificial Sequence
  Description of Artificial Sequence:  Synthetic Peptide
RSRSTPAPM

SEQ ID NO: 7540 - protein, 9 aa, Artificial Sequence
  Description of Artificial Sequence:  Synthetic Peptide
NPRSRSTPA

SEQ ID NO: 7541 - protein, 9 aa, Artificial Sequence
  Description of Artificial Sequence:  Synthetic Peptide
RSRSTPAPM

SEQ ID NO: 7542 - protein, 9 aa, Artificial Sequence
  Description of Artificial Sequence:  Synthetic Peptide
SPLHMAYWF

SEQ ID NO: 7543 - protein, 9 aa, Artificial Sequence
  Description of Artificial Sequence:  Synthetic Peptide
ASKITLSRL

SEQ ID NO: 7544 - protein, 9 aa, Artificial Sequence
  Description of Artificial Sequence:  Synthetic Peptide
KIREGYSRL

SEQ ID NO: 7545 - protein, 9 aa, Artificial Sequence
  Description of Artificial Sequence:  Synthetic Peptide
AASPLHMAY

SEQ ID NO: 7546 - protein, 10 aa, Artificial Sequence
  Description of Artificial Sequence:  Synthetic Peptide
RLASKITLSR

SEQ ID NO: 7547 - protein, 10 aa, Artificial Sequence
  Description of Artificial Sequence:  Synthetic Peptide
HMAYWFHQIR

SEQ ID NO: 7548 - protein, 10 aa, Artificial Sequence
  Description of Artificial Sequence:  Synthetic Peptide
YSRLASKITL

SEQ ID NO: 7549 - protein, 10 aa, Artificial Sequence
  Description of Artificial Sequence:  Synthetic Peptide
APMVASSSPV

SEQ ID NO: 7550 - protein, 10 aa, Artificial Sequence
  Description of Artificial Sequence:  Synthetic Peptide
LASKITLSRL

SEQ ID NO: 7551 - protein, 10 aa, Artificial Sequence
  Description of Artificial Sequence:  Synthetic Peptide
YSRLASKITL

SEQ ID NO: 7552 - protein, 10 aa, Artificial Sequence
  Description of Artificial Sequence:  Synthetic Peptide
KAASPLHMAY

SEQ ID NO: 7553 - protein, 9 aa, Artificial Sequence
  Description of Artificial Sequence:  Synthetic Peptide
HAAQNATRY

SEQ ID NO: 7554 - protein, 9 aa, Artificial Sequence
  Description of Artificial Sequence:  Synthetic Peptide
TLNIEKFTV

SEQ ID NO: 7555 - protein, 9 aa, Artificial Sequence
  Description of Artificial Sequence:  Synthetic Peptide
CPPTNILTL

SEQ ID NO: 7556 - protein, 9 aa, Artificial Sequence
  Description of Artificial Sequence:  Synthetic Peptide
SQRSPLVQL

SEQ ID NO: 7557 - protein, 9 aa, Artificial Sequence
  Description of Artificial Sequence:  Synthetic Peptide
SSRSQRSPL

SEQ ID NO: 7558 - protein, 9 aa, Artificial Sequence
  Description of Artificial Sequence:  Synthetic Peptide
CPPTNILTL

SEQ ID NO: 7559 - protein, 9 aa, Artificial Sequence
  Description of Artificial Sequence:  Synthetic Peptide
SSRSQRSPL

SEQ ID NO: 7560 - protein, 9 aa, Artificial Sequence
  Description of Artificial Sequence:  Synthetic Peptide
SESVVEWSS

SEQ ID NO: 7561 - protein, 10 aa, Artificial Sequence
  Description of Artificial Sequence:  Synthetic Peptide
ILTLNIEKFT

SEQ ID NO: 7562 - protein, 10 aa, Artificial Sequence
  Description of Artificial Sequence:  Synthetic Peptide
LTLNIEKFTV

SEQ ID NO: 7563 - protein, 10 aa, Artificial Sequence
  Description of Artificial Sequence:  Synthetic Peptide
RSQRSPLVQL

SEQ ID NO: 7564 - protein, 10 aa, Artificial Sequence
  Description of Artificial Sequence:  Synthetic Peptide
SSRSQRSPLV

SEQ ID NO: 7565 - protein, 10 aa, Artificial Sequence
  Description of Artificial Sequence:  Synthetic Peptide
RSSRSQRSPL

SEQ ID NO: 7566 - protein, 10 aa, Artificial Sequence
  Description of Artificial Sequence:  Synthetic Peptide
RSQRSPLVQL

SEQ ID NO: 7567 - protein, 9 aa, Artificial Sequence
  Description of Artificial Sequence:  Synthetic Peptide
MLQGGAPQV

SEQ ID NO: 7568 - protein, 9 aa, Artificial Sequence
  Description of Artificial Sequence:  Synthetic Peptide
APQVFTNPV

SEQ ID NO: 7569 - protein, 10 aa, Artificial Sequence
  Description of Artificial Sequence:  Synthetic Peptide
QVFTNPVLFI

SEQ ID NO: 7570 - protein, 10 aa, Artificial Sequence
  Description of Artificial Sequence:  Synthetic Peptide
APQVFTNPVL

SEQ ID NO: 7571 - protein, 10 aa, Artificial Sequence
  Description of Artificial Sequence:  Synthetic Peptide
HPNHRPWGGL

SEQ ID NO: 7572 - protein, 10 aa, Artificial Sequence
  Description of Artificial Sequence:  Synthetic Peptide
HPNHRPWGGL

SEQ ID NO: 7573 - protein, 10 aa, Artificial Sequence
  Description of Artificial Sequence:  Synthetic Peptide
APQVFTNPVL

SEQ ID NO: 7574 - protein, 10 aa, Artificial Sequence
  Description of Artificial Sequence:  Synthetic Peptide
KEVNKKTSDS

SEQ ID NO: 7575 - protein, 10 aa, Artificial Sequence
  Description of Artificial Sequence:  Synthetic Peptide
DIRSGHPEEL

SEQ ID NO: 7576 - protein, 10 aa, Artificial Sequence
  Description of Artificial Sequence:  Synthetic Peptide
RSGHPEELNL

SEQ ID NO: 7577 - protein, 10 aa, Artificial Sequence
  Description of Artificial Sequence:  Synthetic Peptide
DPFELTNCKF

SEQ ID NO: 7578 - protein, 9 aa, Artificial Sequence
  Description of Artificial Sequence:  Synthetic Peptide
STMTTLAQL

SEQ ID NO: 7579 - protein, 10 aa, Artificial Sequence
  Description of Artificial Sequence:  Synthetic Peptide
TLAQLPCMEK

SEQ ID NO: 7580 - protein, 9 aa, Artificial Sequence
  Description of Artificial Sequence:  Synthetic Peptide
LLEQSLVSK

SEQ ID NO: 7581 - protein, 9 aa, Artificial Sequence
  Description of Artificial Sequence:  Synthetic Peptide
MLLLEQSLV

SEQ ID NO: 7582 - protein, 9 aa, Artificial Sequence
  Description of Artificial Sequence:  Synthetic Peptide
KEQPGRFPV

SEQ ID NO: 7583 - protein, 9 aa, Artificial Sequence
  Description of Artificial Sequence:  Synthetic Peptide
KYRPDAFLY

SEQ ID NO: 7584 - protein, 9 aa, Artificial Sequence
  Description of Artificial Sequence:  Synthetic Peptide
LLEQSLVSK

SEQ ID NO: 7585 - protein, 9 aa, Artificial Sequence
  Description of Artificial Sequence:  Synthetic Peptide
VSKYRPDAF

SEQ ID NO: 7586 - protein, 9 aa, Artificial Sequence
  Description of Artificial Sequence:  Synthetic Peptide
LEQSLVSKY

SEQ ID NO: 7587 - protein, 9 aa, Artificial Sequence
  Description of Artificial Sequence:  Synthetic Peptide
IEKEQPGRF

SEQ ID NO: 7588 - protein, 9 aa, Artificial Sequence
  Description of Artificial Sequence:  Synthetic Peptide
KEQPGRFPV

SEQ ID NO: 7589 - protein, 10 aa, Artificial Sequence
  Description of Artificial Sequence:  Synthetic Peptide
LLEQSLVSKY

SEQ ID NO: 7590 - protein, 10 aa, Artificial Sequence
  Description of Artificial Sequence:  Synthetic Peptide
KYRPDAFLYS

SEQ ID NO: 7591 - protein, 10 aa, Artificial Sequence
  Description of Artificial Sequence:  Synthetic Peptide
LLLEQSLVSK

SEQ ID NO: 7592 - protein, 10 aa, Artificial Sequence
  Description of Artificial Sequence:  Synthetic Peptide
LLEQSLVSKY

SEQ ID NO: 7593 - protein, 10 aa, Artificial Sequence
  Description of Artificial Sequence:  Synthetic Peptide
RPDAFLYSRL

SEQ ID NO: 7594 - protein, 10 aa, Artificial Sequence
  Description of Artificial Sequence:  Synthetic Peptide
VSKYRPDAFL

SEQ ID NO: 7595 - protein, 10 aa, Artificial Sequence
  Description of Artificial Sequence:  Synthetic Peptide
RPDAFLYSRL

SEQ ID NO: 7596 - protein, 9 aa, Artificial Sequence
  Description of Artificial Sequence:  Synthetic Peptide
RVSMTLPKL

SEQ ID NO: 7597 - protein, 9 aa, Artificial Sequence
  Description of Artificial Sequence:  Synthetic Peptide
HPAQPQPSF

SEQ ID NO: 7598 - protein, 10 aa, Artificial Sequence
  Description of Artificial Sequence:  Synthetic Peptide
NPHVRVSMTL

SEQ ID NO: 7599 - protein, 10 aa, Artificial Sequence
  Description of Artificial Sequence:  Synthetic Peptide
EPRGGKSHPA

SEQ ID NO: 7600 - protein, 10 aa, Artificial Sequence
  Description of Artificial Sequence:  Synthetic Peptide
YPMRSANPHV

SEQ ID NO: 7601 - protein, 10 aa, Artificial Sequence
  Description of Artificial Sequence:  Synthetic Peptide
EPRGGKSHPA

SEQ ID NO: 7602 - protein, 10 aa, Artificial Sequence
  Description of Artificial Sequence:  Synthetic Peptide
NPHVRVSMTL

SEQ ID NO: 7603 - protein, 10 aa, Artificial Sequence
  Description of Artificial Sequence:  Synthetic Peptide
KLRDLRRGSF

SEQ ID NO: 7604 - protein, 9 aa, Artificial Sequence
  Description of Artificial Sequence:  Synthetic Peptide
PYQAVPQGL

SEQ ID NO: 7605 - protein, 9 aa, Artificial Sequence
  Description of Artificial Sequence:  Synthetic Peptide
GLSRPNTTR

SEQ ID NO: 7606 - protein, 9 aa, Artificial Sequence
  Description of Artificial Sequence:  Synthetic Peptide
LSRPNTTRL

SEQ ID NO: 7607 - protein, 9 aa, Artificial Sequence
  Description of Artificial Sequence:  Synthetic Peptide
RPNTTRLVI

SEQ ID NO: 7608 - protein, 9 aa, Artificial Sequence
  Description of Artificial Sequence:  Synthetic Peptide
LPGHSQAPY

SEQ ID NO: 7609 - protein, 9 aa, Artificial Sequence
  Description of Artificial Sequence:  Synthetic Peptide
RPNTTRLVI

SEQ ID NO: 7610 - protein, 9 aa, Artificial Sequence
  Description of Artificial Sequence:  Synthetic Peptide
LSRPNTTRL

SEQ ID NO: 7611 - protein, 10 aa, Artificial Sequence
  Description of Artificial Sequence:  Synthetic Peptide
GLSRPNTTRL

SEQ ID NO: 7612 - protein, 10 aa, Artificial Sequence
  Description of Artificial Sequence:  Synthetic Peptide
APYQAVPQGL

SEQ ID NO: 7613 - protein, 10 aa, Artificial Sequence
  Description of Artificial Sequence:  Synthetic Peptide
APYQAVPQGL

SEQ ID NO: 7614 - protein, 9 aa, Artificial Sequence
  Description of Artificial Sequence:  Synthetic Peptide
SSRRKRLAM

SEQ ID NO: 7615 - protein, 9 aa, Artificial Sequence
  Description of Artificial Sequence:  Synthetic Peptide
GATLHHESL

SEQ ID NO: 7616 - protein, 9 aa, Artificial Sequence
  Description of Artificial Sequence:  Synthetic Peptide
SSRRKRLAM

SEQ ID NO: 7617 - protein, 10 aa, Artificial Sequence
  Description of Artificial Sequence:  Synthetic Peptide
ELLSSRRKRL

SEQ ID NO: 7618 - protein, 9 aa, Artificial Sequence
  Description of Artificial Sequence:  Synthetic Peptide
SSRRKRLAM

SEQ ID NO: 7619 - protein, 9 aa, Artificial Sequence
  Description of Artificial Sequence:  Synthetic Peptide
LSSRKRLAM

SEQ ID NO: 7620 - protein, 8 aa, Artificial Sequence
  Description of Artificial Sequence:  Synthetic Peptide
LLSSRKRL

SEQ ID NO: 7621 - protein, 10 aa, Artificial Sequence
  Description of Artificial Sequence:  Synthetic Peptide
AASPTSWGTY

SEQ ID NO: 7622 - protein, 10 aa, Artificial Sequence
  Description of Artificial Sequence:  Synthetic Peptide
RSSAPLLEAL

SEQ ID NO: 7623 - protein, 10 aa, Artificial Sequence
  Description of Artificial Sequence:  Synthetic Peptide
GPWRMASGFW

SEQ ID NO: 7624 - protein, 9 aa, Artificial Sequence
  Description of Artificial Sequence:  Synthetic Peptide
GPWRMASGF

SEQ ID NO: 7625 - protein, 9 aa, Artificial Sequence
  Description of Artificial Sequence:  Synthetic Peptide
ASPTSWGTY

SEQ ID NO: 7626 - protein, 9 aa, Artificial Sequence
  Description of Artificial Sequence:  Synthetic Peptide
TPGVGRAIW

SEQ ID NO: 7627 - protein, 10 aa, Artificial Sequence
  Description of Artificial Sequence:  Synthetic Peptide
VAGGRDGSCL

SEQ ID NO: 7628 - protein, 10 aa, Artificial Sequence
  Description of Artificial Sequence:  Synthetic Peptide
AIWVRSSIPL

SEQ ID NO: 7629 - protein, 9 aa, Artificial Sequence
  Description of Artificial Sequence:  Synthetic Peptide
AGGRDGSCL

SEQ ID NO: 7630 - protein, 9 aa, Artificial Sequence
  Description of Artificial Sequence:  Synthetic Peptide
TYRSSAPLL

SEQ ID NO: 7631 - protein, 9 aa, Artificial Sequence
  Description of Artificial Sequence:  Synthetic Peptide
SCLPVALGL

SEQ ID NO: 7632 - protein, 10 aa, Artificial Sequence
  Description of Artificial Sequence:  Synthetic Peptide
AIWVRSSIPL

SEQ ID NO: 7633 - protein, 10 aa, Artificial Sequence
  Description of Artificial Sequence:  Synthetic Peptide
RMASGFWKTA

SEQ ID NO: 7634 - protein, 9 aa, Artificial Sequence
  Description of Artificial Sequence:  Synthetic Peptide
RMASGFWKT

SEQ ID NO: 7635 - protein, 10 aa, Artificial Sequence
  Description of Artificial Sequence:  Synthetic Peptide
LLEALPGPWR

SEQ ID NO: 7636 - protein, 9 aa, Artificial Sequence
  Description of Artificial Sequence:  Synthetic Peptide
QQGTFLVAL

SEQ ID NO: 7637 - protein, 10 aa, Artificial Sequence
  Description of Artificial Sequence:  Synthetic Peptide
SPMIALTRVL

SEQ ID NO: 7638 - protein, 9 aa, Artificial Sequence
  Description of Artificial Sequence:  Synthetic Peptide
SCTLRGVSL

SEQ ID NO: 7639 - protein, 10 aa, Artificial Sequence
  Description of Artificial Sequence:  Synthetic Peptide
SPMIALTRVL

SEQ ID NO: 7640 - protein, 9 aa, Artificial Sequence
  Description of Artificial Sequence:  Synthetic Peptide
SPMIALTRV

SEQ ID NO: 7641 - protein, 10 aa, Artificial Sequence
  Description of Artificial Sequence:  Synthetic Peptide
SLAFARVTPR

SEQ ID NO: 7642 - protein, 9 aa, Artificial Sequence
  Description of Artificial Sequence:  Synthetic Peptide
GVSLAFARV

SEQ ID NO: 7643 - protein, 10 aa, Artificial Sequence
  Description of Artificial Sequence:  Synthetic Peptide
APRLGLLVSL

SEQ ID NO: 7644 - protein, 10 aa, Artificial Sequence
  Description of Artificial Sequence:  Synthetic Peptide
MPAAPRLGLL

SEQ ID NO: 7645 - protein, 10 aa, Artificial Sequence
  Description of Artificial Sequence:  Synthetic Peptide
MPAAPRLGLL

SEQ ID NO: 7646 - protein, 10 aa, Artificial Sequence
  Description of Artificial Sequence:  Synthetic Peptide
APRLGLLVSL

SEQ ID NO: 7647 - protein, 10 aa, Artificial Sequence
  Description of Artificial Sequence:  Synthetic Peptide
APRLGLLVSL

SEQ ID NO: 7648 - protein, 10 aa, Artificial Sequence
  Description of Artificial Sequence:  Synthetic Peptide
MPAAPRLGLL

SEQ ID NO: 7649 - protein, 9 aa, Artificial Sequence
  Description of Artificial Sequence:  Synthetic Peptide
GLLVSLHQA

SEQ ID NO: 7650 - protein, 10 aa, Artificial Sequence
  Description of Artificial Sequence:  Synthetic Peptide
CPQRACVARY

SEQ ID NO: 7651 - protein, 10 aa, Artificial Sequence
  Description of Artificial Sequence:  Synthetic Peptide
ACVARYIASL

SEQ ID NO: 7652 - protein, 10 aa, Artificial Sequence
  Description of Artificial Sequence:  Synthetic Peptide
VQMIRMSSSL

SEQ ID NO: 7653 - protein, 9 aa, Artificial Sequence
  Description of Artificial Sequence:  Synthetic Peptide
CVARYIASL

SEQ ID NO: 7654 - protein, 9 aa, Artificial Sequence
  Description of Artificial Sequence:  Synthetic Peptide
TAGTTLQDL

SEQ ID NO: 7655 - protein, 9 aa, Artificial Sequence
  Description of Artificial Sequence:  Synthetic Peptide
NAPTAGTTL

SEQ ID NO: 7656 - protein, 10 aa, Artificial Sequence
  Description of Artificial Sequence:  Synthetic Peptide
SLPAPWWWER

SEQ ID NO: 7657 - protein, 9 aa, Artificial Sequence
  Description of Artificial Sequence:  Synthetic Peptide
RYIALPAPW

SEQ ID NO: 7658 - protein, 10 aa, Artificial Sequence
  Description of Artificial Sequence:  Synthetic Peptide
RLPTAGVQMI

SEQ ID NO: 7659 - protein, 10 aa, Artificial Sequence
  Description of Artificial Sequence:  Synthetic Peptide
VQMIRMSSSL

SEQ ID NO: 7660 - protein, 9 aa, Artificial Sequence
  Description of Artificial Sequence:  Synthetic Peptide
ALCPQRACV

SEQ ID NO: 7661 - protein, 9 aa, Artificial Sequence
  Description of Artificial Sequence:  Synthetic Peptide
TLQDLVALC

SEQ ID NO: 7662 - protein, 9 aa, Artificial Sequence
  Description of Artificial Sequence:  Synthetic Peptide
QMIRMSSSL

SEQ ID NO: 7663 - protein, 9 aa, Artificial Sequence
  Description of Artificial Sequence:  Synthetic Peptide
HPWPGRTVL

SEQ ID NO: 7664 - protein, 9 aa, Artificial Sequence
  Description of Artificial Sequence:  Synthetic Peptide
CPSSCSSAL

SEQ ID NO: 7665 - protein, 10 aa, Artificial Sequence
  Description of Artificial Sequence:  Synthetic Peptide
RYCLGQPTEW

SEQ ID NO: 7666 - protein, 10 aa, Artificial Sequence
  Description of Artificial Sequence:  Synthetic Peptide
RTTACEIWPL

SEQ ID NO: 7667 - protein, 10 aa, Artificial Sequence
  Description of Artificial Sequence:  Synthetic Peptide
CITISPLFET

SEQ ID NO: 7668 - protein, 9 aa, Artificial Sequence
  Description of Artificial Sequence:  Synthetic Peptide
FETGRTTAC

SEQ ID NO: 7669 - protein, 10 aa, Artificial Sequence
  Description of Artificial Sequence:  Synthetic Peptide
CEIWPLWNQS

SEQ ID NO: 7670 - protein, 10 aa, Artificial Sequence
  Description of Artificial Sequence:  Synthetic Peptide
LPVGARRYCL

SEQ ID NO: 7671 - protein, 10 aa, Artificial Sequence
  Description of Artificial Sequence:  Synthetic Peptide
RPSSSRGGQI

SEQ ID NO: 7672 - protein, 10 aa, Artificial Sequence
  Description of Artificial Sequence:  Synthetic Peptide
LPVGARRYCL

SEQ ID NO: 7673 - protein, 10 aa, Artificial Sequence
  Description of Artificial Sequence:  Synthetic Peptide
LPVGARRYCL

SEQ ID NO: 7674 - protein, 10 aa, Artificial Sequence
  Description of Artificial Sequence:  Synthetic Peptide
TLWAGPLLKV

SEQ ID NO: 7675 - protein, 9 aa, Artificial Sequence
  Description of Artificial Sequence:  Synthetic Peptide
KTLWAGPLL

SEQ ID NO: 7676 - protein, 10 aa, Artificial Sequence
  Description of Artificial Sequence:  Synthetic Peptide
RCIPMWTKTL

SEQ ID NO: 7677 - protein, 10 aa, Artificial Sequence
  Description of Artificial Sequence:  Synthetic Peptide
RGPSHHPRVL

SEQ ID NO: 7678 - protein, 9 aa, Artificial Sequence
  Description of Artificial Sequence:  Synthetic Peptide
TLWAGPLLK

SEQ ID NO: 7679 - protein, 9 aa, Artificial Sequence
  Description of Artificial Sequence:  Synthetic Peptide
GLSTTGPER

SEQ ID NO: 7680 - protein, 9 aa, Artificial Sequence
  Description of Artificial Sequence:  Synthetic Peptide
GPSHHPRVL

SEQ ID NO: 7681 - protein, 9 aa, Artificial Sequence
  Description of Artificial Sequence:  Synthetic Peptide
HPRVLSSRC

SEQ ID NO: 7682 - protein, 10 aa, Artificial Sequence
  Description of Artificial Sequence:  Synthetic Peptide
HPRVLSSRCI

SEQ ID NO: 7683 - protein, 9 aa, Artificial Sequence
  Description of Artificial Sequence:  Synthetic Peptide
GPSHHPRVL

SEQ ID NO: 7684 - protein, 9 aa, Artificial Sequence
  Description of Artificial Sequence:  Synthetic Peptide
IPMWTKTLW

SEQ ID NO: 7685 - protein, 10 aa, Artificial Sequence
  Description of Artificial Sequence:  Synthetic Peptide
HPRVLSSRCI

SEQ ID NO: 7686 - protein, 9 aa, Artificial Sequence
  Description of Artificial Sequence:  Synthetic Peptide
GEVIAGVAC

SEQ ID NO: 7687 - protein, 10 aa, Artificial Sequence
  Description of Artificial Sequence:  Synthetic Peptide
GEVIAGVACF

SEQ ID NO: 7688 - protein, 10 aa, Artificial Sequence
  Description of Artificial Sequence:  Synthetic Peptide
CPRPMGLILI

SEQ ID NO: 7689 - protein, 10 aa, Artificial Sequence
  Description of Artificial Sequence:  Synthetic Peptide
TPLLLQRWAL

SEQ ID NO: 7690 - protein, 9 aa, Artificial Sequence
  Description of Artificial Sequence:  Synthetic Peptide
CPRPMGLIL

SEQ ID NO: 7691 - protein, 9 aa, Artificial Sequence
  Description of Artificial Sequence:  Synthetic Peptide
CPRPMGLIL

SEQ ID NO: 7692 - protein, 10 aa, Artificial Sequence
  Description of Artificial Sequence:  Synthetic Peptide
TPLLLQRWAL

SEQ ID NO: 7693 - protein, 10 aa, Artificial Sequence
  Description of Artificial Sequence:  Synthetic Peptide
ATRCWCSTPL

SEQ ID NO: 7694 - protein, 10 aa, Artificial Sequence
  Description of Artificial Sequence:  Synthetic Peptide
AAVRAPRSRL

SEQ ID NO: 7695 - protein, 10 aa, Artificial Sequence
  Description of Artificial Sequence:  Synthetic Peptide
CPRPMGLILI

SEQ ID NO: 7696 - protein, 9 aa, Artificial Sequence
  Description of Artificial Sequence:  Synthetic Peptide
AVRAPRSRL

SEQ ID NO: 7697 - protein, 9 aa, Artificial Sequence
  Description of Artificial Sequence:  Synthetic Peptide
CPRPMGLIL

SEQ ID NO: 7698 - protein, 9 aa, Artificial Sequence
  Description of Artificial Sequence:  Synthetic Peptide
QPRATRCWC

SEQ ID NO: 7699 - protein, 10 aa, Artificial Sequence
  Description of Artificial Sequence:  Synthetic Peptide
LLLQRWALVL

SEQ ID NO: 7700 - protein, 10 aa, Artificial Sequence
  Description of Artificial Sequence:  Synthetic Peptide
VLTCPRPMGL

SEQ ID NO: 7701 - protein, 10 aa, Artificial Sequence
  Description of Artificial Sequence:  Synthetic Peptide
LLQRWALVLT

SEQ ID NO: 7702 - protein, 9 aa, Artificial Sequence
  Description of Artificial Sequence:  Synthetic Peptide
LLLQRWALV

SEQ ID NO: 7703 - protein, 9 aa, Artificial Sequence
  Description of Artificial Sequence:  Synthetic Peptide
LLQRWALVL

SEQ ID NO: 7704 - protein, 9 aa, Artificial Sequence
  Description of Artificial Sequence:  Synthetic Peptide
PLLLQRWAL

SEQ ID NO: 7705 - protein, 9 aa, Artificial Sequence
  Description of Artificial Sequence:  Synthetic Peptide
WLCSPLLPL

SEQ ID NO: 7706 - protein, 9 aa, Artificial Sequence
  Description of Artificial Sequence:  Synthetic Peptide
LLPLRAPSL

SEQ ID NO: 7707 - protein, 9 aa, Artificial Sequence
  Description of Artificial Sequence:  Synthetic Peptide
ALSLTKQRL

SEQ ID NO: 7708 - protein, 9 aa, Artificial Sequence
  Description of Artificial Sequence:  Synthetic Peptide
RAPSLCPIL

SEQ ID NO: 7709 - protein, 10 aa, Artificial Sequence
  Description of Artificial Sequence:  Synthetic Peptide
MPHPSWASAL

SEQ ID NO: 7710 - protein, 10 aa, Artificial Sequence
  Description of Artificial Sequence:  Synthetic Peptide
HPSWASALSL

SEQ ID NO: 7711 - protein, 10 aa, Artificial Sequence
  Description of Artificial Sequence:  Synthetic Peptide
CPILTSRRLL

SEQ ID NO: 7712 - protein, 10 aa, Artificial Sequence
  Description of Artificial Sequence:  Synthetic Peptide
RGRDWLCSPL

SEQ ID NO: 7713 - protein, 9 aa, Artificial Sequence
  Description of Artificial Sequence:  Synthetic Peptide
CPPPERSPF

SEQ ID NO: 7714 - protein, 9 aa, Artificial Sequence
  Description of Artificial Sequence:  Synthetic Peptide
CPILTSRRL

SEQ ID NO: 7715 - protein, 10 aa, Artificial Sequence
  Description of Artificial Sequence:  Synthetic Peptide
CPILTSRRLL

SEQ ID NO: 7716 - protein, 10 aa, Artificial Sequence
  Description of Artificial Sequence:  Synthetic Peptide
MPHPSWASAL

SEQ ID NO: 7717 - protein, 10 aa, Artificial Sequence
  Description of Artificial Sequence:  Synthetic Peptide
HPSWASALSL

SEQ ID NO: 7718 - protein, 10 aa, Artificial Sequence
  Description of Artificial Sequence:  Synthetic Peptide
KQRLRGRDWL

SEQ ID NO: 7719 - protein, 10 aa, Artificial Sequence
  Description of Artificial Sequence:  Synthetic Peptide
RGRDWLCSPL

SEQ ID NO: 7720 - protein, 10 aa, Artificial Sequence
  Description of Artificial Sequence:  Synthetic Peptide
SALSLTKQRL

SEQ ID NO: 7721 - protein, 9 aa, Artificial Sequence
  Description of Artificial Sequence:  Synthetic Peptide
CPILTSRRL

SEQ ID NO: 7722 - protein, 9 aa, Artificial Sequence
  Description of Artificial Sequence:  Synthetic Peptide
RAPSLCPIL

SEQ ID NO: 7723 - protein, 9 aa, Artificial Sequence
  Description of Artificial Sequence:  Synthetic Peptide
ALSLTKQRL

SEQ ID NO: 7724 - protein, 9 aa, Artificial Sequence
  Description of Artificial Sequence:  Synthetic Peptide
SLCPILTSR

SEQ ID NO: 7725 - protein, 10 aa, Artificial Sequence
  Description of Artificial Sequence:  Synthetic Peptide
RGRDWLCSPL

SEQ ID NO: 7726 - protein, 10 aa, Artificial Sequence
  Description of Artificial Sequence:  Synthetic Peptide
WPTTAVLTCL

SEQ ID NO: 7727 - protein, 10 aa, Artificial Sequence
  Description of Artificial Sequence:  Synthetic Peptide
AAMLSSCRPM

SEQ ID NO: 7728 - protein, 10 aa, Artificial Sequence
  Description of Artificial Sequence:  Synthetic Peptide
AMLSSCRPML

SEQ ID NO: 7729 - protein, 9 aa, Artificial Sequence
  Description of Artificial Sequence:  Synthetic Peptide
MPWPTTAVL

SEQ ID NO: 7730 - protein, 10 aa, Artificial Sequence
  Description of Artificial Sequence:  Synthetic Peptide
WPTTAVLTCL

SEQ ID NO: 7731 - protein, 9 aa, Artificial Sequence
  Description of Artificial Sequence:  Synthetic Peptide
MPWPTTAVL

SEQ ID NO: 7732 - protein, 10 aa, Artificial Sequence
  Description of Artificial Sequence:  Synthetic Peptide
AMLSSCRPML

SEQ ID NO: 7733 - protein, 10 aa, Artificial Sequence
  Description of Artificial Sequence:  Synthetic Peptide
CLSSRPAAML

SEQ ID NO: 7734 - protein, 9 aa, Artificial Sequence
  Description of Artificial Sequence:  Synthetic Peptide
MLSSCRPML

SEQ ID NO: 7735 - protein, 10 aa, Artificial Sequence
  Description of Artificial Sequence:  Synthetic Peptide
SPGLNAGAGL

SEQ ID NO: 7736 - protein, 9 aa, Artificial Sequence
  Description of Artificial Sequence:  Synthetic Peptide
RPPRLQLGY

SEQ ID NO: 7737 - protein, 10 aa, Artificial Sequence
  Description of Artificial Sequence:  Synthetic Peptide
SPGLNAGAGL

SEQ ID NO: 7738 - protein, 10 aa, Artificial Sequence
  Description of Artificial Sequence:  Synthetic Peptide
SVSAMTRAVL

SEQ ID NO: 7739 - protein, 10 aa, Artificial Sequence
  Description of Artificial Sequence:  Synthetic Peptide
LGMSSRPPRL

SEQ ID NO: 7740 - protein, 10 aa, Artificial Sequence
  Description of Artificial Sequence:  Synthetic Peptide
AGGSQASIDL

SEQ ID NO: 7741 - protein, 10 aa, Artificial Sequence
  Description of Artificial Sequence:  Synthetic Peptide
STRPSSVSAM

SEQ ID NO: 7742 - protein, 9 aa, Artificial Sequence
  Description of Artificial Sequence:  Synthetic Peptide
SSRPPRLQL

SEQ ID NO: 7743 - protein, 10 aa, Artificial Sequence
  Description of Artificial Sequence:  Synthetic Peptide
GLAGGSQASI

SEQ ID NO: 7744 - protein, 9 aa, Artificial Sequence
  Description of Artificial Sequence:  Synthetic Peptide
GMSSRPPRL

SEQ ID NO: 7745 - protein, 9 aa, Artificial Sequence
  Description of Artificial Sequence:  Synthetic Peptide
QSRVGRTFL

SEQ ID NO: 7746 - protein, 10 aa, Artificial Sequence
  Description of Artificial Sequence:  Synthetic Peptide
YPRQSRVGRT

SEQ ID NO: 7747 - protein, 9 aa, Artificial Sequence
  Description of Artificial Sequence:  Synthetic Peptide
QSRVGRTFL

SEQ ID NO: 7748 - protein, 10 aa, Artificial Sequence
  Description of Artificial Sequence:  Synthetic Peptide
RQSRVGRTFL

SEQ ID NO: 7749 - protein, 10 aa, Artificial Sequence
  Description of Artificial Sequence:  Synthetic Peptide
HPCYTDWALF

SEQ ID NO: 7750 - protein, 9 aa, Artificial Sequence
  Description of Artificial Sequence:  Synthetic Peptide
HPCYTDWAL

SEQ ID NO: 7751 - protein, 9 aa, Artificial Sequence
  Description of Artificial Sequence:  Synthetic Peptide
HPCYTDWAL

SEQ ID NO: 7752 - protein, 10 aa, Artificial Sequence
  Description of Artificial Sequence:  Synthetic Peptide
CYTDWALFRM

SEQ ID NO: 7753 - protein, 10 aa, Artificial Sequence
  Description of Artificial Sequence:  Synthetic Peptide
YTDWALFRMK

SEQ ID NO: 7754 - protein, 10 aa, Artificial Sequence
  Description of Artificial Sequence:  Synthetic Peptide
ALSTYRTSSK

SEQ ID NO: 7755 - protein, 9 aa, Artificial Sequence
  Description of Artificial Sequence:  Synthetic Peptide
RCLVTPPLL

SEQ ID NO: 7756 - protein, 10 aa, Artificial Sequence
  Description of Artificial Sequence:  Synthetic Peptide
CQRCLVTPPL

SEQ ID NO: 7757 - protein, 10 aa, Artificial Sequence
  Description of Artificial Sequence:  Synthetic Peptide
RPTGRNSRSF

SEQ ID NO: 7758 - protein, 9 aa, Artificial Sequence
  Description of Artificial Sequence:  Synthetic Peptide
MARAWRELL

SEQ ID NO: 7759 - protein, 9 aa, Artificial Sequence
  Description of Artificial Sequence:  Synthetic Peptide
MARAWRELL

SEQ ID NO: 7760 - protein, 10 aa, Artificial Sequence
  Description of Artificial Sequence:  Synthetic Peptide
AMQPPASLPY

SEQ ID NO: 7761 - protein, 9 aa, Artificial Sequence
  Description of Artificial Sequence:  Synthetic Peptide
SLPYSAASL

SEQ ID NO: 7762 - protein, 9 aa, Artificial Sequence
  Description of Artificial Sequence:  Synthetic Peptide
RAMQPPASL

SEQ ID NO: 7763 - protein, 10 aa, Artificial Sequence
  Description of Artificial Sequence:  Synthetic Peptide
AMQPPASLPY

SEQ ID NO: 7764 - protein, 9 aa, Artificial Sequence
  Description of Artificial Sequence:  Synthetic Peptide
RAMQPPASL

SEQ ID NO: 7765 - protein, 10 aa, Artificial Sequence
  Description of Artificial Sequence:  Synthetic Peptide
PPRTTCRRAM

SEQ ID NO: 7766 - protein, 10 aa, Artificial Sequence
  Description of Artificial Sequence:  Synthetic Peptide
ASLPYSAASL

SEQ ID NO: 7767 - protein, 10 aa, Artificial Sequence
  Description of Artificial Sequence:  Synthetic Peptide
PPRTTCRRAM

SEQ ID NO: 7768 - protein, 10 aa, Artificial Sequence
  Description of Artificial Sequence:  Synthetic Peptide
PYLQKFCGSL

SEQ ID NO: 7769 - protein, 9 aa, Artificial Sequence
  Description of Artificial Sequence:  Synthetic Peptide
YLQKFCGSL

SEQ ID NO: 7770 - protein, 10 aa, Artificial Sequence
  Description of Artificial Sequence:  Synthetic Peptide
RSVVGPTRKM

SEQ ID NO: 7771 - protein, 10 aa, Artificial Sequence
  Description of Artificial Sequence:  Synthetic Peptide
QPYLLPWPSL

SEQ ID NO: 7772 - protein, 10 aa, Artificial Sequence
  Description of Artificial Sequence:  Synthetic Peptide
LPCPPWRGSL

SEQ ID NO: 7773 - protein, 10 aa, Artificial Sequence
  Description of Artificial Sequence:  Synthetic Peptide
SPNQPYLLPW

SEQ ID NO: 7774 - protein, 9 aa, Artificial Sequence
  Description of Artificial Sequence:  Synthetic Peptide
WPSLPPKVL

SEQ ID NO: 7775 - protein, 9 aa, Artificial Sequence
  Description of Artificial Sequence:  Synthetic Peptide
SPILPCPPW

SEQ ID NO: 7776 - protein, 10 aa, Artificial Sequence
  Description of Artificial Sequence:  Synthetic Peptide
AARYHLHGPL

SEQ ID NO: 7777 - protein, 10 aa, Artificial Sequence
  Description of Artificial Sequence:  Synthetic Peptide
AARYHLHGPL

SEQ ID NO: 7778 - protein, 10 aa, Artificial Sequence
  Description of Artificial Sequence:  Synthetic Peptide
LPCPPWRGSL

SEQ ID NO: 7779 - protein, 10 aa, Artificial Sequence
  Description of Artificial Sequence:  Synthetic Peptide
QPYLLPWPSL

SEQ ID NO: 7780 - protein, 10 aa, Artificial Sequence
  Description of Artificial Sequence:  Synthetic Peptide
APPTPTLSPI

SEQ ID NO: 7781 - protein, 9 aa, Artificial Sequence
  Description of Artificial Sequence:  Synthetic Peptide
WPSLPPKVL

SEQ ID NO: 7782 - protein, 9 aa, Artificial Sequence
  Description of Artificial Sequence:  Synthetic Peptide
LAAPPTPTL

SEQ ID NO: 7783 - protein, 9 aa, Artificial Sequence
  Description of Artificial Sequence:  Synthetic Peptide
QAHSSPRAL

SEQ ID NO: 7784 - protein, 9 aa, Artificial Sequence
  Description of Artificial Sequence:  Synthetic Peptide
LAAPQLPAL

SEQ ID NO: 7785 - protein, 9 aa, Artificial Sequence
  Description of Artificial Sequence:  Synthetic Peptide
RATIRQHPL

SEQ ID NO: 7786 - protein, 10 aa, Artificial Sequence
  Description of Artificial Sequence:  Synthetic Peptide
LLPWPSLPPK

SEQ ID NO: 7787 - protein, 10 aa, Artificial Sequence
  Description of Artificial Sequence:  Synthetic Peptide
RYHLHGPLLC

SEQ ID NO: 7788 - protein, 9 aa, Artificial Sequence
  Description of Artificial Sequence:  Synthetic Peptide
RYHLHGPLL

SEQ ID NO: 7789 - protein, 9 aa, Artificial Sequence
  Description of Artificial Sequence:  Synthetic Peptide
PYLLPWPSL

SEQ ID NO: 7790 - protein, 9 aa, Artificial Sequence
  Description of Artificial Sequence:  Synthetic Peptide
RQHPLSPPL

SEQ ID NO: 7791 - protein, 10 aa, Artificial Sequence
  Description of Artificial Sequence:  Synthetic Peptide
LLCLRLGKSV

SEQ ID NO: 7792 - protein, 10 aa, Artificial Sequence
  Description of Artificial Sequence:  Synthetic Peptide
VLAAPQLPAL

SEQ ID NO: 7793 - protein, 10 aa, Artificial Sequence
  Description of Artificial Sequence:  Synthetic Peptide
LLAAPPTPTL

SEQ ID NO: 7794 - protein, 10 aa, Artificial Sequence
  Description of Artificial Sequence:  Synthetic Peptide
KMSCAAQCLI

SEQ ID NO: 7795 - protein, 9 aa, Artificial Sequence
  Description of Artificial Sequence:  Synthetic Peptide
KMSCAAQCL

SEQ ID NO: 7796 - protein, 9 aa, Artificial Sequence
  Description of Artificial Sequence:  Synthetic Peptide
SLGIRISAT

SEQ ID NO: 7797 - protein, 9 aa, Artificial Sequence
  Description of Artificial Sequence:  Synthetic Peptide
LLAAPPTPT

SEQ ID NO: 7798 - protein, 9 aa, Artificial Sequence
  Description of Artificial Sequence:  Synthetic Peptide
SLPPKVLAA

SEQ ID NO: 7799 - protein, 9 aa, Artificial Sequence
  Description of Artificial Sequence:  Synthetic Peptide
QLPALRATI

SEQ ID NO: 7800 - protein, 9 aa, Artificial Sequence
  Description of Artificial Sequence:  Synthetic Peptide
HSSPRALRK

SEQ ID NO: 7801 - protein, 10 aa, Artificial Sequence
  Description of Artificial Sequence:  Synthetic Peptide
ATAGAARAAY

SEQ ID NO: 7802 - protein, 10 aa, Artificial Sequence
  Description of Artificial Sequence:  Synthetic Peptide
KPAWPSSLSL

SEQ ID NO: 7803 - protein, 10 aa, Artificial Sequence
  Description of Artificial Sequence:  Synthetic Peptide
WPSSPSLRGF

SEQ ID NO: 7804 - protein, 9 aa, Artificial Sequence
  Description of Artificial Sequence:  Synthetic Peptide
SPSLRGFML

SEQ ID NO: 7805 - protein, 9 aa, Artificial Sequence
  Description of Artificial Sequence:  Synthetic Peptide
SSPSLRGFM

SEQ ID NO: 7806 - protein, 9 aa, Artificial Sequence
  Description of Artificial Sequence:  Synthetic Peptide
SPSLRGFML

SEQ ID NO: 7807 - protein, 10 aa, Artificial Sequence
  Description of Artificial Sequence:  Synthetic Peptide
IPAVLTPQSL

SEQ ID NO: 7808 - protein, 10 aa, Artificial Sequence
  Description of Artificial Sequence:  Synthetic Peptide
KPAWPSSLSL

SEQ ID NO: 7809 - protein, 10 aa, Artificial Sequence
  Description of Artificial Sequence:  Synthetic Peptide
SLRGFMLGAL

SEQ ID NO: 7810 - protein, 10 aa, Artificial Sequence
  Description of Artificial Sequence:  Synthetic Peptide
SVRRRQFTNV

SEQ ID NO: 7811 - protein, 9 aa, Artificial Sequence
  Description of Artificial Sequence:  Synthetic Peptide
SPSLRGFML

SEQ ID NO: 7812 - protein, 9 aa, Artificial Sequence
  Description of Artificial Sequence:  Synthetic Peptide
ALLPIQGGK

SEQ ID NO: 7813 - protein, 10 aa, Artificial Sequence
  Description of Artificial Sequence:  Synthetic Peptide
RQFTNVVTWT

SEQ ID NO: 7814 - protein, 9 aa, Artificial Sequence
  Description of Artificial Sequence:  Synthetic Peptide
FMLGALLPI

SEQ ID NO: 7815 - protein, 9 aa, Artificial Sequence
  Description of Artificial Sequence:  Synthetic Peptide
EEAGLPYVA

SEQ ID NO: 7816 - protein, 10 aa, Artificial Sequence
  Description of Artificial Sequence:  Synthetic Peptide
CELGDTGPGA

SEQ ID NO: 7817 - protein, 10 aa, Artificial Sequence
  Description of Artificial Sequence:  Synthetic Peptide
EEAGLPYVAS

SEQ ID NO: 7818 - protein, 9 aa, Artificial Sequence
  Description of Artificial Sequence:  Synthetic Peptide
CPEEAGLPY

SEQ ID NO: 7819 - protein, 9 aa, Artificial Sequence
  Description of Artificial Sequence:  Synthetic Peptide
GPGASALGF

SEQ ID NO: 7820 - protein, 10 aa, Artificial Sequence
  Description of Artificial Sequence:  Synthetic Peptide
SAHFHSTVTL

SEQ ID NO: 7821 - protein, 9 aa, Artificial Sequence
  Description of Artificial Sequence:  Synthetic Peptide
GFCPEEAGL

SEQ ID NO: 7822 - protein, 9 aa, Artificial Sequence
  Description of Artificial Sequence:  Synthetic Peptide
NLGSRPCEL

SEQ ID NO: 7823 - protein, 9 aa, Artificial Sequence
  Description of Artificial Sequence:  Synthetic Peptide
CPEEAGLPY

SEQ ID NO: 7824 - protein, 9 aa, Artificial Sequence
  Description of Artificial Sequence:  Synthetic Peptide
GPAGSGFAY

SEQ ID NO: 7825 - protein, 9 aa, Artificial Sequence
  Description of Artificial Sequence:  Synthetic Peptide
GPAGSGFAY

SEQ ID NO: 7826 - protein, 9 aa, Artificial Sequence
  Description of Artificial Sequence:  Synthetic Peptide
MPGPAGSGF

SEQ ID NO: 7827 - protein, 10 aa, Artificial Sequence
  Description of Artificial Sequence:  Synthetic Peptide
GELGEGPGSA

SEQ ID NO: 7828 - protein, 10 aa, Artificial Sequence
  Description of Artificial Sequence:  Synthetic Peptide
GEGPGSAAAI

SEQ ID NO: 7829 - protein, 9 aa, Artificial Sequence
  Description of Artificial Sequence:  Synthetic Peptide
DELVPYGSV

SEQ ID NO: 7830 - protein, 9 aa, Artificial Sequence
  Description of Artificial Sequence:  Synthetic Peptide
GELGEGPGS

SEQ ID NO: 7831 - protein, 10 aa, Artificial Sequence
  Description of Artificial Sequence:  Synthetic Peptide
HPTDQHQRQL

SEQ ID NO: 7832 - protein, 9 aa, Artificial Sequence
  Description of Artificial Sequence:  Synthetic Peptide
RPHHGWACW

SEQ ID NO: 7833 - protein, 9 aa, Artificial Sequence
  Description of Artificial Sequence:  Synthetic Peptide
SPGGHSVFL

SEQ ID NO: 7834 - protein, 10 aa, Artificial Sequence
  Description of Artificial Sequence:  Synthetic Peptide
HPTDQHQRQL

SEQ ID NO: 7835 - protein, 9 aa, Artificial Sequence
  Description of Artificial Sequence:  Synthetic Peptide
SPGGHSVFL

SEQ ID NO: 7836 - protein, 9 aa, Artificial Sequence
  Description of Artificial Sequence:  Synthetic Peptide
SVFLHGGEL

SEQ ID NO: 7837 - protein, 10 aa, Artificial Sequence
  Description of Artificial Sequence:  Synthetic Peptide
SLGSPGGHSV

SEQ ID NO: 7838 - protein, 10 aa, Artificial Sequence
  Description of Artificial Sequence:  Synthetic Peptide
SSRFPLIDTL

SEQ ID NO: 7839 - protein, 9 aa, Artificial Sequence
  Description of Artificial Sequence:  Synthetic Peptide
FPLIDTLYL

SEQ ID NO: 7840 - protein, 10 aa, Artificial Sequence
  Description of Artificial Sequence:  Synthetic Peptide
LARSSRFPLI

SEQ ID NO: 7841 - protein, 9 aa, Artificial Sequence
  Description of Artificial Sequence:  Synthetic Peptide
QCGPRPCGL

SEQ ID NO: 7842 - protein, 9 aa, Artificial Sequence
  Description of Artificial Sequence:  Synthetic Peptide
LARSSRFPL

SEQ ID NO: 7843 - protein, 10 aa, Artificial Sequence
  Description of Artificial Sequence:  Synthetic Peptide
SSRFPLIDTL

SEQ ID NO: 7844 - protein, 10 aa, Artificial Sequence
  Description of Artificial Sequence:  Synthetic Peptide
LARSSRFPLI

SEQ ID NO: 7845 - protein, 9 aa, Artificial Sequence
  Description of Artificial Sequence:  Synthetic Peptide
LARSSRFPL

SEQ ID NO: 7846 - protein, 9 aa, Artificial Sequence
  Description of Artificial Sequence:  Synthetic Peptide
FPLIDTLYL

SEQ ID NO: 7847 - protein, 10 aa, Artificial Sequence
  Description of Artificial Sequence:  Synthetic Peptide
RFPLIDTLYL

SEQ ID NO: 7848 - protein, 9 aa, Artificial Sequence
  Description of Artificial Sequence:  Synthetic Peptide
LYLRLLGPL

SEQ ID NO: 7849 - protein, 10 aa, Artificial Sequence
  Description of Artificial Sequence:  Synthetic Peptide
GLARSSRFPL

SEQ ID NO: 7850 - protein, 10 aa, Artificial Sequence
  Description of Artificial Sequence:  Synthetic Peptide
TLYLRLLGPL

SEQ ID NO: 7851 - protein, 9 aa, Artificial Sequence
  Description of Artificial Sequence:  Synthetic Peptide
FPLIDTLYL

SEQ ID NO: 7852 - protein, 9 aa, Artificial Sequence
  Description of Artificial Sequence:  Synthetic Peptide
GARWRRPGC

SEQ ID NO: 7853 - protein, 10 aa, Artificial Sequence
  Description of Artificial Sequence:  Synthetic Peptide
SGRVLPVNRL

SEQ ID NO: 7854 - protein, 9 aa, Artificial Sequence
  Description of Artificial Sequence:  Synthetic Peptide
RPGGRHEHL

SEQ ID NO: 7855 - protein, 9 aa, Artificial Sequence
  Description of Artificial Sequence:  Synthetic Peptide
RPGCSGRVL

SEQ ID NO: 7856 - protein, 10 aa, Artificial Sequence
  Description of Artificial Sequence:  Synthetic Peptide
RLVREAGNYT

SEQ ID NO: 7857 - protein, 9 aa, Artificial Sequence
  Description of Artificial Sequence:  Synthetic Peptide
ASVDKLGVY

SEQ ID NO: 7858 - protein, 9 aa, Artificial Sequence
  Description of Artificial Sequence:  Synthetic Peptide
DEPANSLRL

SEQ ID NO: 7859 - protein, 10 aa, Artificial Sequence
  Description of Artificial Sequence:  Synthetic Peptide
LAKGHLGLDM

SEQ ID NO: 7860 - protein, 9 aa, Artificial Sequence
  Description of Artificial Sequence:  Synthetic Peptide
ASVDKLGVY

SEQ ID NO: 7861 - protein, 10 aa, Artificial Sequence
  Description of Artificial Sequence:  Synthetic Peptide
MLRFLAKGHL

SEQ ID NO: 7862 - protein, 10 aa, Artificial Sequence
  Description of Artificial Sequence:  Synthetic Peptide
GVYHSMLRFL

SEQ ID NO: 7863 - protein, 9 aa, Artificial Sequence
  Description of Artificial Sequence:  Synthetic Peptide
EATASVDKL

SEQ ID NO: 7864 - protein, 10 aa, Artificial Sequence
  Description of Artificial Sequence:  Synthetic Peptide
KLGVYHSMLR

SEQ ID NO: 7865 - protein, 9 aa, Artificial Sequence
  Description of Artificial Sequence:  Synthetic Peptide
GLDMRGAER

SEQ ID NO: 7866 - protein, 10 aa, Artificial Sequence
  Description of Artificial Sequence:  Synthetic Peptide
RFLAKGHLGL

SEQ ID NO: 7867 - protein, 9 aa, Artificial Sequence
  Description of Artificial Sequence:  Synthetic Peptide
VYHSMLRFL

SEQ ID NO: 7868 - protein, 10 aa, Artificial Sequence
  Description of Artificial Sequence:  Synthetic Peptide
GVYHSMLRFL

SEQ ID NO: 7869 - protein, 9 aa, Artificial Sequence
  Description of Artificial Sequence:  Synthetic Peptide
FLAKGHLGL

SEQ ID NO: 7870 - protein, 9 aa, Artificial Sequence
  Description of Artificial Sequence:  Synthetic Peptide
KLGVYHSML

SEQ ID NO: 7871 - protein, 9 aa, Artificial Sequence
  Description of Artificial Sequence:  Synthetic Peptide
GLDMRGAER

SEQ ID NO: 7872 - protein, 9 aa, Artificial Sequence
  Description of Artificial Sequence:  Synthetic Peptide
RPGGRHEHL

SEQ ID NO: 7873 - protein, 9 aa, Artificial Sequence
  Description of Artificial Sequence:  Synthetic Peptide
RPGCSGRVL

SEQ ID NO: 7874 - protein, 10 aa, Artificial Sequence
  Description of Artificial Sequence:  Synthetic Peptide
TPRVPGGVAI

SEQ ID NO: 7875 - protein, 9 aa, Artificial Sequence
  Description of Artificial Sequence:  Synthetic Peptide
APTQVCAPL

SEQ ID NO: 7876 - protein, 9 aa, Artificial Sequence
  Description of Artificial Sequence:  Synthetic Peptide
VPGGVAITL

SEQ ID NO: 7877 - protein, 10 aa, Artificial Sequence
  Description of Artificial Sequence:  Synthetic Peptide
TPRVPGGVAI

SEQ ID NO: 7878 - protein, 10 aa, Artificial Sequence
  Description of Artificial Sequence:  Synthetic Peptide
RVPGGVAITL

SEQ ID NO: 7879 - protein, 10 aa, Artificial Sequence
  Description of Artificial Sequence:  Synthetic Peptide
MPVPDPIARI

SEQ ID NO: 7880 - protein, 10 aa, Artificial Sequence
  Description of Artificial Sequence:  Synthetic Peptide
GAPTQVCAPL

SEQ ID NO: 7881 - protein, 9 aa, Artificial Sequence
  Description of Artificial Sequence:  Synthetic Peptide
APTQVCAPL

SEQ ID NO: 7882 - protein, 9 aa, Artificial Sequence
  Description of Artificial Sequence:  Synthetic Peptide
VPGGVAITL

SEQ ID NO: 7883 - protein, 9 aa, Artificial Sequence
  Description of Artificial Sequence:  Synthetic Peptide
QVCAPLQAL

SEQ ID NO: 7884 - protein, 9 aa, Artificial Sequence
  Description of Artificial Sequence:  Synthetic Peptide
TPRVPGGVA

SEQ ID NO: 7885 - protein, 10 aa, Artificial Sequence
  Description of Artificial Sequence:  Synthetic Peptide
RVPGGVAITL

SEQ ID NO: 7886 - protein, 9 aa, Artificial Sequence
  Description of Artificial Sequence:  Synthetic Peptide
IIQSRTPRV

SEQ ID NO: 7887 - protein, 9 aa, Artificial Sequence
  Description of Artificial Sequence:  Synthetic Peptide
VPDPIARIF

SEQ ID NO: 7888 - protein, 10 aa, Artificial Sequence
  Description of Artificial Sequence:  Synthetic Peptide
RPRRRWKEGL

SEQ ID NO: 7889 - protein, 10 aa, Artificial Sequence
  Description of Artificial Sequence:  Synthetic Peptide
RPRRRWKEGL

SEQ ID NO: 7890 - protein, 10 aa, Artificial Sequence
  Description of Artificial Sequence:  Synthetic Peptide
MPQKTWGPAL

SEQ ID NO: 7891 - protein, 9 aa, Artificial Sequence
  Description of Artificial Sequence:  Synthetic Peptide
SLETPGPER

SEQ ID NO: 7892 - protein, 10 aa, Artificial Sequence
  Description of Artificial Sequence:  Synthetic Peptide
KTWGPALASL

SEQ ID NO: 7893 - protein, 10 aa, Artificial Sequence
  Description of Artificial Sequence:  Synthetic Peptide
MPQKTWGPAL

SEQ ID NO: 7894 - protein, 9 aa, Artificial Sequence
  Description of Artificial Sequence:  Synthetic Peptide
CPAPLVLVL

SEQ ID NO: 7895 - protein, 10 aa, Artificial Sequence
  Description of Artificial Sequence:  Synthetic Peptide
TPARCRGRHL

SEQ ID NO: 7896 - protein, 10 aa, Artificial Sequence
  Description of Artificial Sequence:  Synthetic Peptide
TPARCRGRHL

SEQ ID NO: 7897 - protein, 9 aa, Artificial Sequence
  Description of Artificial Sequence:  Synthetic Peptide
PARCRGRHL

SEQ ID NO: 7898 - protein, 10 aa, Artificial Sequence
  Description of Artificial Sequence:  Synthetic Peptide
TPARCRGRHL

SEQ ID NO: 7899 - protein, 10 aa, Artificial Sequence
  Description of Artificial Sequence:  Synthetic Peptide
SQRVSCPAPL

SEQ ID NO: 7900 - protein, 10 aa, Artificial Sequence
  Description of Artificial Sequence:  Synthetic Peptide
RVSCPAPLVL

SEQ ID NO: 7901 - protein, 9 aa, Artificial Sequence
  Description of Artificial Sequence:  Synthetic Peptide
LVRLVHGWL

SEQ ID NO: 7902 - protein, 9 aa, Artificial Sequence
  Description of Artificial Sequence:  Synthetic Peptide
CPAPLVLVL

SEQ ID NO: 7903 - protein, 9 aa, Artificial Sequence
  Description of Artificial Sequence:  Synthetic Peptide
PARCRGRHL

SEQ ID NO: 7904 - protein, 9 aa, Artificial Sequence
  Description of Artificial Sequence:  Synthetic Peptide
HLPPPQPMK

SEQ ID NO: 7905 - protein, 9 aa, Artificial Sequence
  Description of Artificial Sequence:  Synthetic Peptide
RLVHGWLQR

SEQ ID NO: 7906 - protein, 9 aa, Artificial Sequence
  Description of Artificial Sequence:  Synthetic Peptide
RWPAGLVRL

SEQ ID NO: 7907 - protein, 10 aa, Artificial Sequence
  Description of Artificial Sequence:  Synthetic Peptide
GLVRLVHGWL

SEQ ID NO: 7908 - protein, 9 aa, Artificial Sequence
  Description of Artificial Sequence:  Synthetic Peptide
REASISTLC

SEQ ID NO: 7909 - protein, 10 aa, Artificial Sequence
  Description of Artificial Sequence:  Synthetic Peptide
REASISTLCS

SEQ ID NO: 7910 - protein, 10 aa, Artificial Sequence
  Description of Artificial Sequence:  Synthetic Peptide
ICREASISTL

SEQ ID NO: 7911 - protein, 10 aa, Artificial Sequence
  Description of Artificial Sequence:  Synthetic Peptide
ICREASISTL

SEQ ID NO: 7912 - protein, 9 aa, Artificial Sequence
  Description of Artificial Sequence:  Synthetic Peptide
CVGAPRPIL

SEQ ID NO: 7913 - protein, 10 aa, Artificial Sequence
  Description of Artificial Sequence:  Synthetic Peptide
AARACKGAQT

SEQ ID NO: 7914 - protein, 9 aa, Artificial Sequence
  Description of Artificial Sequence:  Synthetic Peptide
DAVASGAGL

SEQ ID NO: 7915 - protein, 9 aa, Artificial Sequence
  Description of Artificial Sequence:  Synthetic Peptide
PVQRCRWRR

SEQ ID NO: 7916 - protein, 9 aa, Artificial Sequence
  Description of Artificial Sequence:  Synthetic Peptide
SPVQRCRWR

SEQ ID NO: 7917 - protein, 9 aa, Artificial Sequence
  Description of Artificial Sequence:  Synthetic Peptide
RQLGQHPQR

SEQ ID NO: 7918 - protein, 10 aa, Artificial Sequence
  Description of Artificial Sequence:  Synthetic Peptide
SPVQRCRWRR

SEQ ID NO: 7919 - protein, 9 aa, Artificial Sequence
  Description of Artificial Sequence:  Synthetic Peptide
LPPRPRHTL

SEQ ID NO: 7920 - protein, 9 aa, Artificial Sequence
  Description of Artificial Sequence:  Synthetic Peptide
RPRHTLQEC

SEQ ID NO: 7921 - protein, 10 aa, Artificial Sequence
  Description of Artificial Sequence:  Synthetic Peptide
GPSPVQRCRW

SEQ ID NO: 7922 - protein, 10 aa, Artificial Sequence
  Description of Artificial Sequence:  Synthetic Peptide
QELPPRPRHT

SEQ ID NO: 7923 - protein, 9 aa, Artificial Sequence
  Description of Artificial Sequence:  Synthetic Peptide
LPPRPRHTL

SEQ ID NO: 7924 - protein, 9 aa, Artificial Sequence
  Description of Artificial Sequence:  Synthetic Peptide
RPRHTLQEC

SEQ ID NO: 7925 - protein, 10 aa, Artificial Sequence
  Description of Artificial Sequence:  Synthetic Peptide
VQRCRWRRQL

SEQ ID NO: 7926 - protein, 9 aa, Artificial Sequence
  Description of Artificial Sequence:  Synthetic Peptide
ALTGPPSIV

SEQ ID NO: 7927 - protein, 9 aa, Artificial Sequence
  Description of Artificial Sequence:  Synthetic Peptide
KQWRGYQAA

SEQ ID NO: 7928 - protein, 10 aa, Artificial Sequence
  Description of Artificial Sequence:  Synthetic Peptide
KQWRGYQAAL

SEQ ID NO: 7929 - protein, 9 aa, Artificial Sequence
  Description of Artificial Sequence:  Synthetic Peptide
RTSSLSGRR

SEQ ID NO: 7930 - protein, 9 aa, Artificial Sequence
  Description of Artificial Sequence:  Synthetic Peptide
RPASRRARR

SEQ ID NO: 7931 - protein, 9 aa, Artificial Sequence
  Description of Artificial Sequence:  Synthetic Peptide
KLLCHKHLL

SEQ ID NO: 7932 - protein, 10 aa, Artificial Sequence
  Description of Artificial Sequence:  Synthetic Peptide
LLCHKHLLST

SEQ ID NO: 7933 - protein, 10 aa, Artificial Sequence
  Description of Artificial Sequence:  Synthetic Peptide
LLSTRRRQGT

SEQ ID NO: 7934 - protein, 9 aa, Artificial Sequence
  Description of Artificial Sequence:  Synthetic Peptide
KLLCHKHLL

SEQ ID NO: 7935 - protein, 10 aa, Artificial Sequence
  Description of Artificial Sequence:  Synthetic Peptide
STRRRQGTCR

SEQ ID NO: 7936 - protein, 10 aa, Artificial Sequence
  Description of Artificial Sequence:  Synthetic Peptide
GTRHKLLCHK

SEQ ID NO: 7937 - protein, 10 aa, Artificial Sequence
  Description of Artificial Sequence:  Synthetic Peptide
HPWSGTRHKL

SEQ ID NO: 7938 - protein, 10 aa, Artificial Sequence
  Description of Artificial Sequence:  Synthetic Peptide
HPWSGTRHKL

SEQ ID NO: 7939 - protein, 9 aa, Artificial Sequence
  Description of Artificial Sequence:  Synthetic Peptide
SPQGLGPHW

SEQ ID NO: 7940 - protein, 10 aa, Artificial Sequence
  Description of Artificial Sequence:  Synthetic Peptide
SPQGLGPHWY

SEQ ID NO: 7941 - protein, 9 aa, Artificial Sequence
  Description of Artificial Sequence:  Synthetic Peptide
WSSFRPRGR

SEQ ID NO: 7942 - protein, 9 aa, Artificial Sequence
  Description of Artificial Sequence:  Synthetic Peptide
RPRGRQSSI

SEQ ID NO: 7943 - protein, 9 aa, Artificial Sequence
  Description of Artificial Sequence:  Synthetic Peptide
RPRGRQSSI

SEQ ID NO: 7944 - protein, 9 aa, Artificial Sequence
  Description of Artificial Sequence:  Synthetic Peptide
RPRGRQSSI

SEQ ID NO: 7945 - protein, 9 aa, Artificial Sequence
  Description of Artificial Sequence:  Synthetic Peptide
ATESAPLTR

SEQ ID NO: 7946 - protein, 9 aa, Artificial Sequence
  Description of Artificial Sequence:  Synthetic Peptide
DTTQSRRTR

SEQ ID NO: 7947 - protein, 9 aa, Artificial Sequence
  Description of Artificial Sequence:  Synthetic Peptide
ATESAPLTR

SEQ ID NO: 7948 - protein, 9 aa, Artificial Sequence
  Description of Artificial Sequence:  Synthetic Peptide
RTRGRTQDR

SEQ ID NO: 7949 - protein, 9 aa, Artificial Sequence
  Description of Artificial Sequence:  Synthetic Peptide
EATSRRGRR

SEQ ID NO: 7950 - protein, 9 aa, Artificial Sequence
  Description of Artificial Sequence:  Synthetic Peptide
APLTRQEQR

SEQ ID NO: 7951 - protein, 9 aa, Artificial Sequence
  Description of Artificial Sequence:  Synthetic Peptide
GAGGEATSR

SEQ ID NO: 7952 - protein, 10 aa, Artificial Sequence
  Description of Artificial Sequence:  Synthetic Peptide
TTRPPPCPVR

SEQ ID NO: 7953 - protein, 10 aa, Artificial Sequence
  Description of Artificial Sequence:  Synthetic Peptide
TTQSRRTRGR

SEQ ID NO: 7954 - protein, 10 aa, Artificial Sequence
  Description of Artificial Sequence:  Synthetic Peptide
APLTRQEQRR

SEQ ID NO: 7955 - protein, 10 aa, Artificial Sequence
  Description of Artificial Sequence:  Synthetic Peptide
TSRRGRRPLR

SEQ ID NO: 7956 - protein, 10 aa, Artificial Sequence
  Description of Artificial Sequence:  Synthetic Peptide
GAGGEATSRR

SEQ ID NO: 7957 - protein, 9 aa, Artificial Sequence
  Description of Artificial Sequence:  Synthetic Peptide
RPPPCPVRM

SEQ ID NO: 7958 - protein, 9 aa, Artificial Sequence
  Description of Artificial Sequence:  Synthetic Peptide
TSRRGRRPL

SEQ ID NO: 7959 - protein, 9 aa, Artificial Sequence
  Description of Artificial Sequence:  Synthetic Peptide
TSRRGRRPL

SEQ ID NO: 7960 - protein, 9 aa, Artificial Sequence
  Description of Artificial Sequence:  Synthetic Peptide
RPPPCPVRM

SEQ ID NO: 7961 - protein, 10 aa, Artificial Sequence
  Description of Artificial Sequence:  Synthetic Peptide
ATSRRGRRPL

SEQ ID NO: 7962 - protein, 9 aa, Artificial Sequence
  Description of Artificial Sequence:  Synthetic Peptide
GSNQWGRAR

SEQ ID NO: 7963 - protein, 9 aa, Artificial Sequence
  Description of Artificial Sequence:  Synthetic Peptide
VCGSNQWGR

SEQ ID NO: 7964 - protein, 10 aa, Artificial Sequence
  Description of Artificial Sequence:  Synthetic Peptide
DVCGSNQWGR

SEQ ID NO: 7965 - protein, 9 aa, Artificial Sequence
  Description of Artificial Sequence:  Synthetic Peptide
RARCCCPPL

SEQ ID NO: 7966 - protein, 9 aa, Artificial Sequence
  Description of Artificial Sequence:  Synthetic Peptide
RARCCCPPL

SEQ ID NO: 7967 - protein, 10 aa, Artificial Sequence
  Description of Artificial Sequence:  Synthetic Peptide
ALPGGGVLEA

SEQ ID NO: 7968 - protein, 9 aa, Artificial Sequence
  Description of Artificial Sequence:  Synthetic Peptide
VLEAARHSY

SEQ ID NO: 7969 - protein, 9 aa, Artificial Sequence
  Description of Artificial Sequence:  Synthetic Peptide
MALPGGGVL

SEQ ID NO: 7970 - protein, 9 aa, Artificial Sequence
  Description of Artificial Sequence:  Synthetic Peptide
RSRQNQNQR

SEQ ID NO: 7971 - protein, 9 aa, Artificial Sequence
  Description of Artificial Sequence:  Synthetic Peptide
SFLRHAATL

SEQ ID NO: 7972 - protein, 10 aa, Artificial Sequence
  Description of Artificial Sequence:  Synthetic Peptide
SFLRHAATLL

SEQ ID NO: 7973 - protein, 9 aa, Artificial Sequence
  Description of Artificial Sequence:  Synthetic Peptide
MAALPPLDR

SEQ ID NO: 7974 - protein, 9 aa, Artificial Sequence
  Description of Artificial Sequence:  Synthetic Peptide
SLARTLRAR

SEQ ID NO: 7975 - protein, 10 aa, Artificial Sequence
  Description of Artificial Sequence:  Synthetic Peptide
RSLARTLRAR

SEQ ID NO: 7976 - protein, 9 aa, Artificial Sequence
  Description of Artificial Sequence:  Synthetic Peptide
FLRHAATLL

SEQ ID NO: 7977 - protein, 9 aa, Artificial Sequence
  Description of Artificial Sequence:  Synthetic Peptide
ALPPLDRSL

SEQ ID NO: 7978 - protein, 10 aa, Artificial Sequence
  Description of Artificial Sequence:  Synthetic Peptide
LARTLRARCL

SEQ ID NO: 7979 - protein, 10 aa, Artificial Sequence
  Description of Artificial Sequence:  Synthetic Peptide
AALPPLDRSL

SEQ ID NO: 7980 - protein, 10 aa, Artificial Sequence
  Description of Artificial Sequence:  Synthetic Peptide
LARTLRARCL

SEQ ID NO: 7981 - protein, 9 aa, Artificial Sequence
  Description of Artificial Sequence:  Synthetic Peptide
CLAVSHAAL

SEQ ID NO: 7982 - protein, 9 aa, Artificial Sequence
  Description of Artificial Sequence:  Synthetic Peptide
MIMLPSQEL

SEQ ID NO: 7983 - protein, 9 aa, Artificial Sequence
  Description of Artificial Sequence:  Synthetic Peptide
IMLPSQELT

SEQ ID NO: 7984 - protein, 10 aa, Artificial Sequence
  Description of Artificial Sequence:  Synthetic Peptide
MLPSQELTGV

SEQ ID NO: 7985 - protein, 10 aa, Artificial Sequence
  Description of Artificial Sequence:  Synthetic Peptide
VISIILAHSV

SEQ ID NO: 7986 - protein, 10 aa, Artificial Sequence
  Description of Artificial Sequence:  Synthetic Peptide
NMIMLPSQEL

SEQ ID NO: 7987 - protein, 9 aa, Artificial Sequence
  Description of Artificial Sequence:  Synthetic Peptide
TLKKWVISI

SEQ ID NO: 7988 - protein, 9 aa, Artificial Sequence
  Description of Artificial Sequence:  Synthetic Peptide
AVSHAALAR

SEQ ID NO: 7989 - protein, 10 aa, Artificial Sequence
  Description of Artificial Sequence:  Synthetic Peptide
LAVSHAALAR

SEQ ID NO: 7990 - protein, 10 aa, Artificial Sequence
  Description of Artificial Sequence:  Synthetic Peptide
ALARGVVGSR

SEQ ID NO: 7991 - protein, 9 aa, Artificial Sequence
  Description of Artificial Sequence:  Synthetic Peptide
HSVGANMIM

SEQ ID NO: 7992 - protein, 9 aa, Artificial Sequence
  Description of Artificial Sequence:  Synthetic Peptide
QELTGVCLA

SEQ ID NO: 7993 - protein, 10 aa, Artificial Sequence
  Description of Artificial Sequence:  Synthetic Peptide
QELTGVCLAV

SEQ ID NO: 7994 - protein, 9 aa, Artificial Sequence
  Description of Artificial Sequence:  Synthetic Peptide
SVGANMIML

SEQ ID NO: 7995 - protein, 9 aa, Artificial Sequence
  Description of Artificial Sequence:  Synthetic Peptide
MIMLPSQEL

SEQ ID NO: 7996 - protein, 9 aa, Artificial Sequence
  Description of Artificial Sequence:  Synthetic Peptide
SPAARQAAR

SEQ ID NO: 7997 - protein, 10 aa, Artificial Sequence
  Description of Artificial Sequence:  Synthetic Peptide
MVQSWSPAAR

SEQ ID NO: 7998 - protein, 10 aa, Artificial Sequence
  Description of Artificial Sequence:  Synthetic Peptide
WSPAARQAAR

SEQ ID NO: 7999 - protein, 10 aa, Artificial Sequence
  Description of Artificial Sequence:  Synthetic Peptide
AARQAARALM

SEQ ID NO: 8000 - protein, 9 aa, Artificial Sequence
  Description of Artificial Sequence:  Synthetic Peptide
AARQAARAL

SEQ ID NO: 8001 - protein, 10 aa, Artificial Sequence
  Description of Artificial Sequence:  Synthetic Peptide
AARQAARALM

SEQ ID NO: 8002 - protein, 9 aa, Artificial Sequence
  Description of Artificial Sequence:  Synthetic Peptide
AARQAARAL

SEQ ID NO: 8003 - protein, 9 aa, Artificial Sequence
  Description of Artificial Sequence:  Synthetic Peptide
YENPIGVFL

SEQ ID NO: 8004 - protein, 9 aa, Artificial Sequence
  Description of Artificial Sequence:  Synthetic Peptide
VSYENPIGV

SEQ ID NO: 8005 - protein, 10 aa, Artificial Sequence
  Description of Artificial Sequence:  Synthetic Peptide
TVESKQRVSY

SEQ ID NO: 8006 - protein, 9 aa, Artificial Sequence
  Description of Artificial Sequence:  Synthetic Peptide
SYENPIGVF

SEQ ID NO: 8007 - protein, 10 aa, Artificial Sequence
  Description of Artificial Sequence:  Synthetic Peptide
SYENPIGVFL

SEQ ID NO: 8008 - protein, 9 aa, Artificial Sequence
  Description of Artificial Sequence:  Synthetic Peptide
SLSVTVESK

SEQ ID NO: 8009 - protein, 9 aa, Artificial Sequence
  Description of Artificial Sequence:  Synthetic Peptide
SVTVESKQR

SEQ ID NO: 8010 - protein, 10 aa, Artificial Sequence
  Description of Artificial Sequence:  Synthetic Peptide
LSVTVESKQR

SEQ ID NO: 8011 - protein, 10 aa, Artificial Sequence
  Description of Artificial Sequence:  Synthetic Peptide
MSLSVTVESK

SEQ ID NO: 8012 - protein, 9 aa, Artificial Sequence
  Description of Artificial Sequence:  Synthetic Peptide
NPIGVFLDF

SEQ ID NO: 8013 - protein, 9 aa, Artificial Sequence
  Description of Artificial Sequence:  Synthetic Peptide
NSTRCPGEY

SEQ ID NO: 8014 - protein, 10 aa, Artificial Sequence
  Description of Artificial Sequence:  Synthetic Peptide
VSYENPIGVF

SEQ ID NO: 8015 - protein, 9 aa, Artificial Sequence
  Description of Artificial Sequence:  Synthetic Peptide
VESKQRVSY

SEQ ID NO: 8016 - protein, 9 aa, Artificial Sequence
  Description of Artificial Sequence:  Synthetic Peptide
NPIGVFLDF

SEQ ID NO: 8017 - protein, 9 aa, Artificial Sequence
  Description of Artificial Sequence:  Synthetic Peptide
LMWATAFLA

SEQ ID NO: 8018 - protein, 9 aa, Artificial Sequence
  Description of Artificial Sequence:  Synthetic Peptide
ELMWATAFL

SEQ ID NO: 8019 - protein, 10 aa, Artificial Sequence
  Description of Artificial Sequence:  Synthetic Peptide
FLAWQRTSFA

SEQ ID NO: 8020 - protein, 10 aa, Artificial Sequence
  Description of Artificial Sequence:  Synthetic Peptide
TLSSRRSFHT

SEQ ID NO: 8021 - protein, 10 aa, Artificial Sequence
  Description of Artificial Sequence:  Synthetic Peptide
MMVVSIGVTL

SEQ ID NO: 8022 - protein, 10 aa, Artificial Sequence
  Description of Artificial Sequence:  Synthetic Peptide
HTELMWATAF

SEQ ID NO: 8023 - protein, 10 aa, Artificial Sequence
  Description of Artificial Sequence:  Synthetic Peptide
AFLAWQRTSF

SEQ ID NO: 8024 - protein, 9 aa, Artificial Sequence
  Description of Artificial Sequence:  Synthetic Peptide
ATAFLAWQR

SEQ ID NO: 8025 - protein, 9 aa, Artificial Sequence
  Description of Artificial Sequence:  Synthetic Peptide
SIGVTLSSR

SEQ ID NO: 8026 - protein, 10 aa, Artificial Sequence
  Description of Artificial Sequence:  Synthetic Peptide
VSIGVTLSSR

SEQ ID NO: 8027 - protein, 10 aa, Artificial Sequence
  Description of Artificial Sequence:  Synthetic Peptide
SIGVTLSSRR

SEQ ID NO: 8028 - protein, 10 aa, Artificial Sequence
  Description of Artificial Sequence:  Synthetic Peptide
SSRRSFHTEL

SEQ ID NO: 8029 - protein, 9 aa, Artificial Sequence
  Description of Artificial Sequence:  Synthetic Peptide
TELMWATAF

SEQ ID NO: 8030 - protein, 10 aa, Artificial Sequence
  Description of Artificial Sequence:  Synthetic Peptide
TELMWATAFL

SEQ ID NO: 8031 - protein, 9 aa, Artificial Sequence
  Description of Artificial Sequence:  Synthetic Peptide
MVVSIGVTL

SEQ ID NO: 8032 - protein, 9 aa, Artificial Sequence
  Description of Artificial Sequence:  Synthetic Peptide
ELMWATAFL

SEQ ID NO: 8033 - protein, 10 aa, Artificial Sequence
  Description of Artificial Sequence:  Synthetic Peptide
SSRRSFHTEL

SEQ ID NO: 8034 - protein, 9 aa, Artificial Sequence
  Description of Artificial Sequence:  Synthetic Peptide
KAVDRVDSV

SEQ ID NO: 8035 - protein, 9 aa, Artificial Sequence
  Description of Artificial Sequence:  Synthetic Peptide
LVASSAKAV

SEQ ID NO: 8036 - protein, 10 aa, Artificial Sequence
  Description of Artificial Sequence:  Synthetic Peptide
LLVASSAKAV

SEQ ID NO: 8037 - protein, 10 aa, Artificial Sequence
  Description of Artificial Sequence:  Synthetic Peptide
KLLVASSAKA

SEQ ID NO: 8038 - protein, 9 aa, Artificial Sequence
  Description of Artificial Sequence:  Synthetic Peptide
MPEVEELPK

SEQ ID NO: 8039 - protein, 9 aa, Artificial Sequence
  Description of Artificial Sequence:  Synthetic Peptide
KLLVASSAK

SEQ ID NO: 8040 - protein, 9 aa, Artificial Sequence
  Description of Artificial Sequence:  Synthetic Peptide
AVDRVDSVR

SEQ ID NO: 8041 - protein, 9 aa, Artificial Sequence
  Description of Artificial Sequence:  Synthetic Peptide
ASSAKAVDR

SEQ ID NO: 8042 - protein, 9 aa, Artificial Sequence
  Description of Artificial Sequence:  Synthetic Peptide
EVEELPKLL

SEQ ID NO: 8043 - protein, 10 aa, Artificial Sequence
  Description of Artificial Sequence:  Synthetic Peptide
RVDSVRTTVR

SEQ ID NO: 8044 - protein, 10 aa, Artificial Sequence
  Description of Artificial Sequence:  Synthetic Peptide
SVRTTVRFFR

SEQ ID NO: 8045 - protein, 10 aa, Artificial Sequence
  Description of Artificial Sequence:  Synthetic Peptide
KAVDRVDSVR

SEQ ID NO: 8046 - protein, 10 aa, Artificial Sequence
  Description of Artificial Sequence:  Synthetic Peptide
EVEELPKLLV

SEQ ID NO: 8047 - protein, 9 aa, Artificial Sequence
  Description of Artificial Sequence:  Synthetic Peptide
EELPKLLVA

SEQ ID NO: 8048 - protein, 10 aa, Artificial Sequence
  Description of Artificial Sequence:  Synthetic Peptide
EELPKLLVAS

SEQ ID NO: 8049 - protein, 10 aa, Artificial Sequence
  Description of Artificial Sequence:  Synthetic Peptide
DSVRTTVRFF

SEQ ID NO: 8050 - protein, 10 aa, Artificial Sequence
  Description of Artificial Sequence:  Synthetic Peptide
MPEVEELPKL

SEQ ID NO: 8051 - protein, 9 aa, Artificial Sequence
  Description of Artificial Sequence:  Synthetic Peptide
NLLPAASAV

SEQ ID NO: 8052 - protein, 9 aa, Artificial Sequence
  Description of Artificial Sequence:  Synthetic Peptide
VIWEGSVSM

SEQ ID NO: 8053 - protein, 9 aa, Artificial Sequence
  Description of Artificial Sequence:  Synthetic Peptide
GIWHGHLRL

SEQ ID NO: 8054 - protein, 9 aa, Artificial Sequence
  Description of Artificial Sequence:  Synthetic Peptide
RLSVVIPDT

SEQ ID NO: 8055 - protein, 9 aa, Artificial Sequence
  Description of Artificial Sequence:  Synthetic Peptide
CLHRRLASM

SEQ ID NO: 8056 - protein, 10 aa, Artificial Sequence
  Description of Artificial Sequence:  Synthetic Peptide
ALRDGADSWL

SEQ ID NO: 8057 - protein, 10 aa, Artificial Sequence
  Description of Artificial Sequence:  Synthetic Peptide
NLLPAASAVI

SEQ ID NO: 8058 - protein, 9 aa, Artificial Sequence
  Description of Artificial Sequence:  Synthetic Peptide
NCDPTGYSW

SEQ ID NO: 8059 - protein, 9 aa, Artificial Sequence
  Description of Artificial Sequence:  Synthetic Peptide
KGLQGGANL

SEQ ID NO: 8060 - protein, 9 aa, Artificial Sequence
  Description of Artificial Sequence:  Synthetic Peptide
WLAVQVALR

SEQ ID NO: 8061 - protein, 10 aa, Artificial Sequence
  Description of Artificial Sequence:  Synthetic Peptide
GLQGGANLCR

SEQ ID NO: 8062 - protein, 10 aa, Artificial Sequence
  Description of Artificial Sequence:  Synthetic Peptide
MLPPISCLHR

SEQ ID NO: 8063 - protein, 9 aa, Artificial Sequence
  Description of Artificial Sequence:  Synthetic Peptide
WLAVQVALR

SEQ ID NO: 8064 - protein, 9 aa, Artificial Sequence
  Description of Artificial Sequence:  Synthetic Peptide
PTLNDTSSR

SEQ ID NO: 8065 - protein, 9 aa, Artificial Sequence
  Description of Artificial Sequence:  Synthetic Peptide
LQGGANLCR

SEQ ID NO: 8066 - protein, 10 aa, Artificial Sequence
  Description of Artificial Sequence:  Synthetic Peptide
MLPPISCLHR

SEQ ID NO: 8067 - protein, 10 aa, Artificial Sequence
  Description of Artificial Sequence:  Synthetic Peptide
LQGGANLCRR

SEQ ID NO: 8068 - protein, 9 aa, Artificial Sequence
  Description of Artificial Sequence:  Synthetic Peptide
LPAASAVIW

SEQ ID NO: 8069 - protein, 10 aa, Artificial Sequence
  Description of Artificial Sequence:  Synthetic Peptide
GESWLAVQVA

SEQ ID NO: 8070 - protein, 9 aa, Artificial Sequence
  Description of Artificial Sequence:  Synthetic Peptide
LAIEGGDPL

SEQ ID NO: 8071 - protein, 10 aa, Artificial Sequence
  Description of Artificial Sequence:  Synthetic Peptide
ALRDGADSWL

SEQ ID NO: 8072 - protein, 10 aa, Artificial Sequence
  Description of Artificial Sequence:  Synthetic Peptide
AVIWEGSVSM

SEQ ID NO: 8073 - protein, 10 aa, Artificial Sequence
  Description of Artificial Sequence:  Synthetic Peptide
ALRDGADSWL

SEQ ID NO: 8074 - protein, 9 aa, Artificial Sequence
  Description of Artificial Sequence:  Synthetic Peptide
VLGPTILIV

SEQ ID NO: 8075 - protein, 9 aa, Artificial Sequence
  Description of Artificial Sequence:  Synthetic Peptide
GMSLAFSQV

SEQ ID NO: 8076 - protein, 9 aa, Artificial Sequence
  Description of Artificial Sequence:  Synthetic Peptide
FLTCPVISA

SEQ ID NO: 8077 - protein, 9 aa, Artificial Sequence
  Description of Artificial Sequence:  Synthetic Peptide
FLQVLGPTI

SEQ ID NO: 8078 - protein, 9 aa, Artificial Sequence
  Description of Artificial Sequence:  Synthetic Peptide
TILIVPFLT

SEQ ID NO: 8079 - protein, 9 aa, Artificial Sequence
  Description of Artificial Sequence:  Synthetic Peptide
ILIVPFLTC

SEQ ID NO: 8080 - protein, 9 aa, Artificial Sequence
  Description of Artificial Sequence:  Synthetic Peptide
IVPFLTCPV

SEQ ID NO: 8081 - protein, 10 aa, Artificial Sequence
  Description of Artificial Sequence:  Synthetic Peptide
SLSQEPEHGV

SEQ ID NO: 8082 - protein, 10 aa, Artificial Sequence
  Description of Artificial Sequence:  Synthetic Peptide
FLQVLGPTIL

SEQ ID NO: 8083 - protein, 10 aa, Artificial Sequence
  Description of Artificial Sequence:  Synthetic Peptide
VISAPQWQRV

SEQ ID NO: 8084 - protein, 10 aa, Artificial Sequence
  Description of Artificial Sequence:  Synthetic Peptide
IMPSPRQTPL

SEQ ID NO: 8085 - protein, 10 aa, Artificial Sequence
  Description of Artificial Sequence:  Synthetic Peptide
GMSLAFSQVL

SEQ ID NO: 8086 - protein, 10 aa, Artificial Sequence
  Description of Artificial Sequence:  Synthetic Peptide
QVLGPTILIV

SEQ ID NO: 8087 - protein, 10 aa, Artificial Sequence
  Description of Artificial Sequence:  Synthetic Peptide
LIVPFLTCPV

SEQ ID NO: 8088 - protein, 10 aa, Artificial Sequence
  Description of Artificial Sequence:  Synthetic Peptide
NVPLHMFLQV

SEQ ID NO: 8089 - protein, 9 aa, Artificial Sequence
  Description of Artificial Sequence:  Synthetic Peptide
AFSQVLKSL

SEQ ID NO: 8090 - protein, 9 aa, Artificial Sequence
  Description of Artificial Sequence:  Synthetic Peptide
SLAFSQVLK

SEQ ID NO: 8091 - protein, 10 aa, Artificial Sequence
  Description of Artificial Sequence:  Synthetic Peptide
PLYPRWQDTK

SEQ ID NO: 8092 - protein, 9 aa, Artificial Sequence
  Description of Artificial Sequence:  Synthetic Peptide
RVCIMPSPR

SEQ ID NO: 8093 - protein, 9 aa, Artificial Sequence
  Description of Artificial Sequence:  Synthetic Peptide
GVVHSELIH

SEQ ID NO: 8094 - protein, 10 aa, Artificial Sequence
  Description of Artificial Sequence:  Synthetic Peptide
PVISAPQWQR

SEQ ID NO: 8095 - protein, 10 aa, Artificial Sequence
  Description of Artificial Sequence:  Synthetic Peptide
MSLAFSQVLK

SEQ ID NO: 8096 - protein, 9 aa, Artificial Sequence
  Description of Artificial Sequence:  Synthetic Peptide
GPTILIVPF

SEQ ID NO: 8097 - protein, 9 aa, Artificial Sequence
  Description of Artificial Sequence:  Synthetic Peptide
MPSPRQTPL

SEQ ID NO: 8098 - protein, 9 aa, Artificial Sequence
  Description of Artificial Sequence:  Synthetic Peptide
IPGSCGMSL

SEQ ID NO: 8099 - protein, 9 aa, Artificial Sequence
  Description of Artificial Sequence:  Synthetic Peptide
CPVISAPQW

SEQ ID NO: 8100 - protein, 10 aa, Artificial Sequence
  Description of Artificial Sequence:  Synthetic Peptide
APQWQRVCIM

SEQ ID NO: 8101 - protein, 10 aa, Artificial Sequence
  Description of Artificial Sequence:  Synthetic Peptide
MPSPRQTPLY

SEQ ID NO: 8102 - protein, 10 aa, Artificial Sequence
  Description of Artificial Sequence:  Synthetic Peptide
YPRWQDTKGI

SEQ ID NO: 8103 - protein, 10 aa, Artificial Sequence
  Description of Artificial Sequence:  Synthetic Peptide
VPLHMFLQVL

SEQ ID NO: 8104 - protein, 10 aa, Artificial Sequence
  Description of Artificial Sequence:  Synthetic Peptide
GPTILIVPFL

SEQ ID NO: 8105 - protein, 10 aa, Artificial Sequence
  Description of Artificial Sequence:  Synthetic Peptide
LSTSHIQSQM

SEQ ID NO: 8106 - protein, 10 aa, Artificial Sequence
  Description of Artificial Sequence:  Synthetic Peptide
QEPEHGVVHS

SEQ ID NO: 8107 - protein, 9 aa, Artificial Sequence
  Description of Artificial Sequence:  Synthetic Peptide
MPSPRQTPL

SEQ ID NO: 8108 - protein, 9 aa, Artificial Sequence
  Description of Artificial Sequence:  Synthetic Peptide
IPGSCGMSL

SEQ ID NO: 8109 - protein, 9 aa, Artificial Sequence
  Description of Artificial Sequence:  Synthetic Peptide
APQWQRVCI

SEQ ID NO: 8110 - protein, 10 aa, Artificial Sequence
  Description of Artificial Sequence:  Synthetic Peptide
VPLHMFLQVL

SEQ ID NO: 8111 - protein, 10 aa, Artificial Sequence
  Description of Artificial Sequence:  Synthetic Peptide
GPTILIVPFL

SEQ ID NO: 8112 - protein, 10 aa, Artificial Sequence
  Description of Artificial Sequence:  Synthetic Peptide
YPRWQDTKGI

SEQ ID NO: 8113 - protein, 10 aa, Artificial Sequence
  Description of Artificial Sequence:  Synthetic Peptide
APQWQRVCIM

SEQ ID NO: 8114 - protein, 10 aa, Artificial Sequence
  Description of Artificial Sequence:  Synthetic Peptide
LAFSQVLKSL

SEQ ID NO: 8115 - protein, 9 aa, Artificial Sequence
  Description of Artificial Sequence:  Synthetic Peptide
MPSPRQTPL

SEQ ID NO: 8116 - protein, 9 aa, Artificial Sequence
  Description of Artificial Sequence:  Synthetic Peptide
AVTRAAASL

SEQ ID NO: 8117 - protein, 10 aa, Artificial Sequence
  Description of Artificial Sequence:  Synthetic Peptide
MAVTRAAASL

SEQ ID NO: 8118 - protein, 9 aa, Artificial Sequence
  Description of Artificial Sequence:  Synthetic Peptide
MLKRRVWPV

SEQ ID NO: 8119 - protein, 9 aa, Artificial Sequence
  Description of Artificial Sequence:  Synthetic Peptide
RVWPVVSGL

SEQ ID NO: 8120 - protein, 9 aa, Artificial Sequence
  Description of Artificial Sequence:  Synthetic Peptide
AINEAMAGL

SEQ ID NO: 8121 - protein, 9 aa, Artificial Sequence
  Description of Artificial Sequence:  Synthetic Peptide
CQLVWTAGV

SEQ ID NO: 8122 - protein, 9 aa, Artificial Sequence
  Description of Artificial Sequence:  Synthetic Peptide
KTSSFCQLV

SEQ ID NO: 8123 - protein, 10 aa, Artificial Sequence
  Description of Artificial Sequence:  Synthetic Peptide
NMLKRRVWPV

SEQ ID NO: 8124 - protein, 10 aa, Artificial Sequence
  Description of Artificial Sequence:  Synthetic Peptide
GLVTAAVKAI

SEQ ID NO: 8125 - protein, 10 aa, Artificial Sequence
  Description of Artificial Sequence:  Synthetic Peptide
ILNATRAPAT

SEQ ID NO: 8126 - protein, 10 aa, Artificial Sequence
  Description of Artificial Sequence:  Synthetic Peptide
VVSGLVTAAV

SEQ ID NO: 8127 - protein, 9 aa, Artificial Sequence
  Description of Artificial Sequence:  Synthetic Peptide
ATHPPNMLK

SEQ ID NO: 8128 - protein, 10 aa, Artificial Sequence
  Description of Artificial Sequence:  Synthetic Peptide
ATHPPNMLKR

SEQ ID NO: 8129 - protein, 9 aa, Artificial Sequence
  Description of Artificial Sequence:  Synthetic Peptide
KYCIPLMKF

SEQ ID NO: 8130 - protein, 9 aa, Artificial Sequence
  Description of Artificial Sequence:  Synthetic Peptide
RVWPVVSGL

SEQ ID NO: 8131 - protein, 9 aa, Artificial Sequence
  Description of Artificial Sequence:  Synthetic Peptide
CFAQKTSSF

SEQ ID NO: 8132 - protein, 10 aa, Artificial Sequence
  Description of Artificial Sequence:  Synthetic Peptide
KAINEAMAGL

SEQ ID NO: 8133 - protein, 10 aa, Artificial Sequence
  Description of Artificial Sequence:  Synthetic Peptide
SIIPCSMYGK

SEQ ID NO: 8134 - protein, 9 aa, Artificial Sequence
  Description of Artificial Sequence:  Synthetic Peptide
ATPAPYPAR

SEQ ID NO: 8135 - protein, 9 aa, Artificial Sequence
  Description of Artificial Sequence:  Synthetic Peptide
ATHPPNMLK

SEQ ID NO: 8136 - protein, 10 aa, Artificial Sequence
  Description of Artificial Sequence:  Synthetic Peptide
ATHPPNMLKR

SEQ ID NO: 8137 - protein, 10 aa, Artificial Sequence
  Description of Artificial Sequence:  Synthetic Peptide
TSAWRDAVCR

SEQ ID NO: 8138 - protein, 10 aa, Artificial Sequence
  Description of Artificial Sequence:  Synthetic Peptide
VSGLVTAAVK

SEQ ID NO: 8139 - protein, 10 aa, Artificial Sequence
  Description of Artificial Sequence:  Synthetic Peptide
PTLPMAAPAR

SEQ ID NO: 8140 - protein, 10 aa, Artificial Sequence
  Description of Artificial Sequence:  Synthetic Peptide
SPLMILNATR

SEQ ID NO: 8141 - protein, 10 aa, Artificial Sequence
  Description of Artificial Sequence:  Synthetic Peptide
MAGLPGSVDR

SEQ ID NO: 8142 - protein, 10 aa, Artificial Sequence
  Description of Artificial Sequence:  Synthetic Peptide
TAGVITSAWR

SEQ ID NO: 8143 - protein, 9 aa, Artificial Sequence
  Description of Artificial Sequence:  Synthetic Peptide
TPAPYPARM

SEQ ID NO: 8144 - protein, 9 aa, Artificial Sequence
  Description of Artificial Sequence:  Synthetic Peptide
RPAKYCIPL

SEQ ID NO: 8145 - protein, 9 aa, Artificial Sequence
  Description of Artificial Sequence:  Synthetic Peptide
GSVDRPAKY

SEQ ID NO: 8146 - protein, 9 aa, Artificial Sequence
  Description of Artificial Sequence:  Synthetic Peptide
RAPATPAPY

SEQ ID NO: 8147 - protein, 9 aa, Artificial Sequence
  Description of Artificial Sequence:  Synthetic Peptide
RPRAFCLNC

SEQ ID NO: 8148 - protein, 9 aa, Artificial Sequence
  Description of Artificial Sequence:  Synthetic Peptide
SSVEGTSPL

SEQ ID NO: 8149 - protein, 9 aa, Artificial Sequence
  Description of Artificial Sequence:  Synthetic Peptide
ASIIPCSMY

SEQ ID NO: 8150 - protein, 10 aa, Artificial Sequence
  Description of Artificial Sequence:  Synthetic Peptide
RPAKYCIPLM

SEQ ID NO: 8151 - protein, 10 aa, Artificial Sequence
  Description of Artificial Sequence:  Synthetic Peptide
IPLMKFHMCF

SEQ ID NO: 8152 - protein, 10 aa, Artificial Sequence
  Description of Artificial Sequence:  Synthetic Peptide
SSVEGTSPLM

SEQ ID NO: 8153 - protein, 10 aa, Artificial Sequence
  Description of Artificial Sequence:  Synthetic Peptide
YPARMSTRTF

SEQ ID NO: 8154 - protein, 10 aa, Artificial Sequence
  Description of Artificial Sequence:  Synthetic Peptide
RPRAFCLNCS

SEQ ID NO: 8155 - protein, 10 aa, Artificial Sequence
  Description of Artificial Sequence:  Synthetic Peptide
RSSVEGTSPL

SEQ ID NO: 8156 - protein, 10 aa, Artificial Sequence
  Description of Artificial Sequence:  Synthetic Peptide
CSASIIPCSM

SEQ ID NO: 8157 - protein, 9 aa, Artificial Sequence
  Description of Artificial Sequence:  Synthetic Peptide
ASIIPCSMY

SEQ ID NO: 8158 - protein, 10 aa, Artificial Sequence
  Description of Artificial Sequence:  Synthetic Peptide
NEAMAGLPGS

SEQ ID NO: 8159 - protein, 9 aa, Artificial Sequence
  Description of Artificial Sequence:  Synthetic Peptide
RPAKYCIPL

SEQ ID NO: 8160 - protein, 9 aa, Artificial Sequence
  Description of Artificial Sequence:  Synthetic Peptide
AATHPPNML

SEQ ID NO: 8161 - protein, 9 aa, Artificial Sequence
  Description of Artificial Sequence:  Synthetic Peptide
TPAPYPARM

SEQ ID NO: 8162 - protein, 9 aa, Artificial Sequence
  Description of Artificial Sequence:  Synthetic Peptide
RVWPVVSGL

SEQ ID NO: 8163 - protein, 9 aa, Artificial Sequence
  Description of Artificial Sequence:  Synthetic Peptide
RPRAFCLNC

SEQ ID NO: 8164 - protein, 9 aa, Artificial Sequence
  Description of Artificial Sequence:  Synthetic Peptide
AVKAINEAM

SEQ ID NO: 8165 - protein, 9 aa, Artificial Sequence
  Description of Artificial Sequence:  Synthetic Peptide
AINEAMAGL

SEQ ID NO: 8166 - protein, 10 aa, Artificial Sequence
  Description of Artificial Sequence:  Synthetic Peptide
STRTFPSPTL

SEQ ID NO: 8167 - protein, 10 aa, Artificial Sequence
  Description of Artificial Sequence:  Synthetic Peptide
VCRRPRAFCL

SEQ ID NO: 8168 - protein, 10 aa, Artificial Sequence
  Description of Artificial Sequence:  Synthetic Peptide
RPAKYCIPLM

SEQ ID NO: 8169 - protein, 10 aa, Artificial Sequence
  Description of Artificial Sequence:  Synthetic Peptide
WAATHPPNML

SEQ ID NO: 8170 - protein, 10 aa, Artificial Sequence
  Description of Artificial Sequence:  Synthetic Peptide
KAINEAMAGL

SEQ ID NO: 8171 - protein, 10 aa, Artificial Sequence
  Description of Artificial Sequence:  Synthetic Peptide
AQKTSSFCQL

SEQ ID NO: 8172 - protein, 9 aa, Artificial Sequence
  Description of Artificial Sequence:  Synthetic Peptide
MLKRRVWPV

SEQ ID NO: 8173 - protein, 10 aa, Artificial Sequence
  Description of Artificial Sequence:  Synthetic Peptide
VCRRPRAFCL

SEQ ID NO: 8174 - protein, 9 aa, Artificial Sequence
  Description of Artificial Sequence:  Synthetic Peptide
YLVIGCVRV

SEQ ID NO: 8175 - protein, 9 aa, Artificial Sequence
  Description of Artificial Sequence:  Synthetic Peptide
MMYLVIGCV

SEQ ID NO: 8176 - protein, 9 aa, Artificial Sequence
  Description of Artificial Sequence:  Synthetic Peptide
VMMYLVIGC

SEQ ID NO: 8177 - protein, 10 aa, Artificial Sequence
  Description of Artificial Sequence:  Synthetic Peptide
VMMYLVIGCV

SEQ ID NO: 8178 - protein, 9 aa, Artificial Sequence
  Description of Artificial Sequence:  Synthetic Peptide
SADMHVMMY

SEQ ID NO: 8179 - protein, 9 aa, Artificial Sequence
  Description of Artificial Sequence:  Synthetic Peptide
TTQPVDRQY

SEQ ID NO: 8180 - protein, 10 aa, Artificial Sequence
  Description of Artificial Sequence:  Synthetic Peptide
RTPPTSTQVL

SEQ ID NO: 8181 - protein, 10 aa, Artificial Sequence
  Description of Artificial Sequence:  Synthetic Peptide
MMYLVIGCVR

SEQ ID NO: 8182 - protein, 9 aa, Artificial Sequence
  Description of Artificial Sequence:  Synthetic Peptide
PVDRQYAAR

SEQ ID NO: 8183 - protein, 9 aa, Artificial Sequence
  Description of Artificial Sequence:  Synthetic Peptide
TQVLVTTSR

SEQ ID NO: 8184 - protein, 10 aa, Artificial Sequence
  Description of Artificial Sequence:  Synthetic Peptide
STQVLVTTSR

SEQ ID NO: 8185 - protein, 10 aa, Artificial Sequence
  Description of Artificial Sequence:  Synthetic Peptide
QPVDRQYAAR

SEQ ID NO: 8186 - protein, 9 aa, Artificial Sequence
  Description of Artificial Sequence:  Synthetic Peptide
RSADMHVMM

SEQ ID NO: 8187 - protein, 9 aa, Artificial Sequence
  Description of Artificial Sequence:  Synthetic Peptide
TPPTSTQVL

SEQ ID NO: 8188 - protein, 10 aa, Artificial Sequence
  Description of Artificial Sequence:  Synthetic Peptide
TSRSADMHVM

SEQ ID NO: 8189 - protein, 10 aa, Artificial Sequence
  Description of Artificial Sequence:  Synthetic Peptide
RSADMHVMMY

SEQ ID NO: 8190 - protein, 9 aa, Artificial Sequence
  Description of Artificial Sequence:  Synthetic Peptide
SADMHVMMY

SEQ ID NO: 8191 - protein, 10 aa, Artificial Sequence
  Description of Artificial Sequence:  Synthetic Peptide
RSADMHVMMY

SEQ ID NO: 8192 - protein, 9 aa, Artificial Sequence
  Description of Artificial Sequence:  Synthetic Peptide
TPPTSTQVL

SEQ ID NO: 8193 - protein, 9 aa, Artificial Sequence
  Description of Artificial Sequence:  Synthetic Peptide
AARTPPTST

SEQ ID NO: 8194 - protein, 10 aa, Artificial Sequence
  Description of Artificial Sequence:  Synthetic Peptide
TSRSADMHVM

SEQ ID NO: 8195 - protein, 10 aa, Artificial Sequence
  Description of Artificial Sequence:  Synthetic Peptide
AARAARTPPT

SEQ ID NO: 8196 - protein, 9 aa, Artificial Sequence
  Description of Artificial Sequence:  Synthetic Peptide
SLTVVSAGV

SEQ ID NO: 8197 - protein, 10 aa, Artificial Sequence
  Description of Artificial Sequence:  Synthetic Peptide
EGRSPGATNL

SEQ ID NO: 8198 - protein, 9 aa, Artificial Sequence
  Description of Artificial Sequence:  Synthetic Peptide
FPLPVLPRR

SEQ ID NO: 8199 - protein, 9 aa, Artificial Sequence
  Description of Artificial Sequence:  Synthetic Peptide
MPGFPLPVL

SEQ ID NO: 8200 - protein, 9 aa, Artificial Sequence
  Description of Artificial Sequence:  Synthetic Peptide
MPGFPLPVL

SEQ ID NO: 8201 - protein, 10 aa, Artificial Sequence
  Description of Artificial Sequence:  Synthetic Peptide
KVGSRLKSTV

SEQ ID NO: 8202 - protein, 9 aa, Artificial Sequence
  Description of Artificial Sequence:  Synthetic Peptide
MVKVGSRLK

SEQ ID NO: 8203 - protein, 9 aa, Artificial Sequence
  Description of Artificial Sequence:  Synthetic Peptide
LVGMTDTSR

SEQ ID NO: 8204 - protein, 9 aa, Artificial Sequence
  Description of Artificial Sequence:  Synthetic Peptide
SFAASSSHF

SEQ ID NO: 8205 - protein, 10 aa, Artificial Sequence
  Description of Artificial Sequence:  Synthetic Peptide
FFEWQKMRCL

SEQ ID NO: 8206 - protein, 10 aa, Artificial Sequence
  Description of Artificial Sequence:  Synthetic Peptide
SFAASSSHFF

SEQ ID NO: 8207 - protein, 10 aa, Artificial Sequence
  Description of Artificial Sequence:  Synthetic Peptide
RCLPPLITSR

SEQ ID NO: 8208 - protein, 10 aa, Artificial Sequence
  Description of Artificial Sequence:  Synthetic Peptide
SSHFFFEWQK

SEQ ID NO: 8209 - protein, 10 aa, Artificial Sequence
  Description of Artificial Sequence:  Synthetic Peptide
TVTEPGGVAV

SEQ ID NO: 8210 - protein, 9 aa, Artificial Sequence
  Description of Artificial Sequence:  Synthetic Peptide
VTEPGGVAV

SEQ ID NO: 8211 - protein, 10 aa, Artificial Sequence
  Description of Artificial Sequence:  Synthetic Peptide
VTEPGGVAVA

SEQ ID NO: 8212 - protein, 9 aa, Artificial Sequence
  Description of Artificial Sequence:  Synthetic Peptide
APAVSAWSR

SEQ ID NO: 8213 - protein, 9 aa, Artificial Sequence
  Description of Artificial Sequence:  Synthetic Peptide
MPKMDVASV

SEQ ID NO: 8214 - protein, 10 aa, Artificial Sequence
  Description of Artificial Sequence:  Synthetic Peptide
WSRTVPMPKM

SEQ ID NO: 8215 - protein, 10 aa, Artificial Sequence
  Description of Artificial Sequence:  Synthetic Peptide
VSAWSRTVPM

SEQ ID NO: 8216 - protein, 9 aa, Artificial Sequence
  Description of Artificial Sequence:  Synthetic Peptide
TEPGGVAVA

SEQ ID NO: 8217 - protein, 10 aa, Artificial Sequence
  Description of Artificial Sequence:  Synthetic Peptide
TEPGGVAVAS

SEQ ID NO: 8218 - protein, 9 aa, Artificial Sequence
  Description of Artificial Sequence:  Synthetic Peptide
VAVASTTSL

SEQ ID NO: 8219 - protein, 10 aa, Artificial Sequence
  Description of Artificial Sequence:  Synthetic Peptide
GVAVASTTSL

SEQ ID NO: 8220 - protein, 10 aa, Artificial Sequence
  Description of Artificial Sequence:  Synthetic Peptide
WSRTVPMPKM

SEQ ID NO: 8221 - protein, 9 aa, Artificial Sequence
  Description of Artificial Sequence:  Synthetic Peptide
ILGSTPWAL

SEQ ID NO: 8222 - protein, 9 aa, Artificial Sequence
  Description of Artificial Sequence:  Synthetic Peptide
LILGSTPWA

SEQ ID NO: 8223 - protein, 9 aa, Artificial Sequence
  Description of Artificial Sequence:  Synthetic Peptide
GLPVVIVLT

SEQ ID NO: 8224 - protein, 9 aa, Artificial Sequence
  Description of Artificial Sequence:  Synthetic Peptide
IVLTPVLIL

SEQ ID NO: 8225 - protein, 10 aa, Artificial Sequence
  Description of Artificial Sequence:  Synthetic Peptide
LILGSTPWAL

SEQ ID NO: 8226 - protein, 10 aa, Artificial Sequence
  Description of Artificial Sequence:  Synthetic Peptide
VLILGSTPWA

SEQ ID NO: 8227 - protein, 9 aa, Artificial Sequence
  Description of Artificial Sequence:  Synthetic Peptide
MGLPVVIVL

SEQ ID NO: 8228 - protein, 9 aa, Artificial Sequence
  Description of Artificial Sequence:  Synthetic Peptide
GSTPWALDM

SEQ ID NO: 8229 - protein, 9 aa, Artificial Sequence
  Description of Artificial Sequence:  Synthetic Peptide
IVLTPVLIL

SEQ ID NO: 8230 - protein, 9 aa, Artificial Sequence
  Description of Artificial Sequence:  Synthetic Peptide
VVIVLTPVL

SEQ ID NO: 8231 - protein, 10 aa, Artificial Sequence
  Description of Artificial Sequence:  Synthetic Peptide
ALATPRVHTA

SEQ ID NO: 8232 - protein, 9 aa, Artificial Sequence
  Description of Artificial Sequence:  Synthetic Peptide
RVHTAALNR

SEQ ID NO: 8233 - protein, 9 aa, Artificial Sequence
  Description of Artificial Sequence:  Synthetic Peptide
KSTALATPR

SEQ ID NO: 8234 - protein, 10 aa, Artificial Sequence
  Description of Artificial Sequence:  Synthetic Peptide
VVPRFSTGIK

SEQ ID NO: 8235 - protein, 10 aa, Artificial Sequence
  Description of Artificial Sequence:  Synthetic Peptide
NSGPPEEPFK

SEQ ID NO: 8236 - protein, 10 aa, Artificial Sequence
  Description of Artificial Sequence:  Synthetic Peptide
MVVPRFSTGI

SEQ ID NO: 8237 - protein, 9 aa, Artificial Sequence
  Description of Artificial Sequence:  Synthetic Peptide
TPRVHTAAL

SEQ ID NO: 8238 - protein, 9 aa, Artificial Sequence
  Description of Artificial Sequence:  Synthetic Peptide
TPRVHTAAL

SEQ ID NO: 8239 - protein, 10 aa, Artificial Sequence
  Description of Artificial Sequence:  Synthetic Peptide
ATPRVHTAAL

SEQ ID NO: 8240 - protein, 9 aa, Artificial Sequence
  Description of Artificial Sequence:  Synthetic Peptide
TPRVHTAAL

SEQ ID NO: 8241 - protein, 9 aa, Artificial Sequence
  Description of Artificial Sequence:  Synthetic Peptide
RGESRLPLL

SEQ ID NO: 8242 - protein, 10 aa, Artificial Sequence
  Description of Artificial Sequence:  Synthetic Peptide
GMTSACLVTR

SEQ ID NO: 8243 - protein, 9 aa, Artificial Sequence
  Description of Artificial Sequence:  Synthetic Peptide
MTSACLVTR

SEQ ID NO: 8244 - protein, 9 aa, Artificial Sequence
  Description of Artificial Sequence:  Synthetic Peptide
LPLLSPRRR

SEQ ID NO: 8245 - protein, 10 aa, Artificial Sequence
  Description of Artificial Sequence:  Synthetic Peptide
ESRLPLLSPR

SEQ ID NO: 8246 - protein, 9 aa, Artificial Sequence
  Description of Artificial Sequence:  Synthetic Peptide
LSPRRRTGM

SEQ ID NO: 8247 - protein, 9 aa, Artificial Sequence
  Description of Artificial Sequence:  Synthetic Peptide
SPRRRTGMT

SEQ ID NO: 8248 - protein, 10 aa, Artificial Sequence
  Description of Artificial Sequence:  Synthetic Peptide
MGRGESRLPL

SEQ ID NO: 8249 - protein, 9 aa, Artificial Sequence
  Description of Artificial Sequence:  Synthetic Peptide
SPRRRTGMT

SEQ ID NO: 8250 - protein, 9 aa, Artificial Sequence
  Description of Artificial Sequence:  Synthetic Peptide
PLGDAMVLV

SEQ ID NO: 8251 - protein, 9 aa, Artificial Sequence
  Description of Artificial Sequence:  Synthetic Peptide
GPLGDAMVL

SEQ ID NO: 8252 - protein, 9 aa, Artificial Sequence
  Description of Artificial Sequence:  Synthetic Peptide
GPLGDAMVL

SEQ ID NO: 8253 - protein, 9 aa, Artificial Sequence
  Description of Artificial Sequence:  Synthetic Peptide
LMMSPHAAV

SEQ ID NO: 8254 - protein, 9 aa, Artificial Sequence
  Description of Artificial Sequence:  Synthetic Peptide
FLSRPVRLV

SEQ ID NO: 8255 - protein, 9 aa, Artificial Sequence
  Description of Artificial Sequence:  Synthetic Peptide
WTSPSTWFL

SEQ ID NO: 8256 - protein, 9 aa, Artificial Sequence
  Description of Artificial Sequence:  Synthetic Peptide
KVWVAVDTI

SEQ ID NO: 8257 - protein, 9 aa, Artificial Sequence
  Description of Artificial Sequence:  Synthetic Peptide
WVAVDTIWT

SEQ ID NO: 8258 - protein, 9 aa, Artificial Sequence
  Description of Artificial Sequence:  Synthetic Peptide
IIHPRRPLV

SEQ ID NO: 8259 - protein, 10 aa, Artificial Sequence
  Description of Artificial Sequence:  Synthetic Peptide
VMGASNLHPL

SEQ ID NO: 8260 - protein, 10 aa, Artificial Sequence
  Description of Artificial Sequence:  Synthetic Peptide
FLSRPVRLVI

SEQ ID NO: 8261 - protein, 10 aa, Artificial Sequence
  Description of Artificial Sequence:  Synthetic Peptide
VIIHPRRPLV

SEQ ID NO: 8262 - protein, 9 aa, Artificial Sequence
  Description of Artificial Sequence:  Synthetic Peptide
WFLSRPVRL

SEQ ID NO: 8263 - protein, 10 aa, Artificial Sequence
  Description of Artificial Sequence:  Synthetic Peptide
AYAVMGASNL

SEQ ID NO: 8264 - protein, 9 aa, Artificial Sequence
  Description of Artificial Sequence:  Synthetic Peptide
HVMSLVSIR

SEQ ID NO: 8265 - protein, 9 aa, Artificial Sequence
  Description of Artificial Sequence:  Synthetic Peptide
STATARSRR

SEQ ID NO: 8266 - protein, 9 aa, Artificial Sequence
  Description of Artificial Sequence:  Synthetic Peptide
TTGSTATAR

SEQ ID NO: 8267 - protein, 9 aa, Artificial Sequence
  Description of Artificial Sequence:  Synthetic Peptide
MSLVSIREK

SEQ ID NO: 8268 - protein, 9 aa, Artificial Sequence
  Description of Artificial Sequence:  Synthetic Peptide
GSTATARSR

SEQ ID NO: 8269 - protein, 9 aa, Artificial Sequence
  Description of Artificial Sequence:  Synthetic Peptide
RLVIIHPRR

SEQ ID NO: 8270 - protein, 9 aa, Artificial Sequence
  Description of Artificial Sequence:  Synthetic Peptide
RPLCAQSRR

SEQ ID NO: 8271 - protein, 10 aa, Artificial Sequence
  Description of Artificial Sequence:  Synthetic Peptide
STWFLSRPVR

SEQ ID NO: 8272 - protein, 10 aa, Artificial Sequence
  Description of Artificial Sequence:  Synthetic Peptide
KTTGSTATAR

SEQ ID NO: 8273 - protein, 10 aa, Artificial Sequence
  Description of Artificial Sequence:  Synthetic Peptide
PVRLVIIHPR

SEQ ID NO: 8274 - protein, 10 aa, Artificial Sequence
  Description of Artificial Sequence:  Synthetic Peptide
TSPSTWFLSR

SEQ ID NO: 8275 - protein, 10 aa, Artificial Sequence
  Description of Artificial Sequence:  Synthetic Peptide
GSTATARSRR

SEQ ID NO: 8276 - protein, 10 aa, Artificial Sequence
  Description of Artificial Sequence:  Synthetic Peptide
LCAQSRRGVR

SEQ ID NO: 8277 - protein, 9 aa, Artificial Sequence
  Description of Artificial Sequence:  Synthetic Peptide
HPRRPLVCW

SEQ ID NO: 8278 - protein, 9 aa, Artificial Sequence
  Description of Artificial Sequence:  Synthetic Peptide
GPSSISWPL

SEQ ID NO: 8279 - protein, 9 aa, Artificial Sequence
  Description of Artificial Sequence:  Synthetic Peptide
QSRRGVRWL

SEQ ID NO: 8280 - protein, 10 aa, Artificial Sequence
  Description of Artificial Sequence:  Synthetic Peptide
QSRRGVRWLY

SEQ ID NO: 8281 - protein, 9 aa, Artificial Sequence
  Description of Artificial Sequence:  Synthetic Peptide
AETGKPLMM

SEQ ID NO: 8282 - protein, 10 aa, Artificial Sequence
  Description of Artificial Sequence:  Synthetic Peptide
AETGKPLMMS

SEQ ID NO: 8283 - protein, 9 aa, Artificial Sequence
  Description of Artificial Sequence:  Synthetic Peptide
GPSSISWPL

SEQ ID NO: 8284 - protein, 9 aa, Artificial Sequence
  Description of Artificial Sequence:  Synthetic Peptide
QSRRGVRWL

SEQ ID NO: 8285 - protein, 9 aa, Artificial Sequence
  Description of Artificial Sequence:  Synthetic Peptide
ATARSRRPL

SEQ ID NO: 8286 - protein, 9 aa, Artificial Sequence
  Description of Artificial Sequence:  Synthetic Peptide
YAVMGASNL

SEQ ID NO: 8287 - protein, 10 aa, Artificial Sequence
  Description of Artificial Sequence:  Synthetic Peptide
AVSAPHVMSL

SEQ ID NO: 8288 - protein, 10 aa, Artificial Sequence
  Description of Artificial Sequence:  Synthetic Peptide
LVIIHPRRPL

SEQ ID NO: 8289 - protein, 10 aa, Artificial Sequence
  Description of Artificial Sequence:  Synthetic Peptide
APHVMSLVSI

SEQ ID NO: 8290 - protein, 10 aa, Artificial Sequence
  Description of Artificial Sequence:  Synthetic Peptide
HPRRPLVCWA

SEQ ID NO: 8291 - protein, 10 aa, Artificial Sequence
  Description of Artificial Sequence:  Synthetic Peptide
TATARSRRPL

SEQ ID NO: 8292 - protein, 10 aa, Artificial Sequence
  Description of Artificial Sequence:  Synthetic Peptide
AGPSSISWPL

SEQ ID NO: 8293 - protein, 10 aa, Artificial Sequence
  Description of Artificial Sequence:  Synthetic Peptide
AQSRRGVRWL

SEQ ID NO: 8294 - protein, 9 aa, Artificial Sequence
  Description of Artificial Sequence:  Synthetic Peptide
TARSRRPLC

SEQ ID NO: 8295 - protein, 10 aa, Artificial Sequence
  Description of Artificial Sequence:  Synthetic Peptide
LSRPVRLVII

SEQ ID NO: 8296 - protein, 10 aa, Artificial Sequence
  Description of Artificial Sequence:  Synthetic Peptide
TARSRRPLCA

SEQ ID NO: 8297 - protein, 9 aa, Artificial Sequence
  Description of Artificial Sequence:  Synthetic Peptide
SLVMSNTRV

SEQ ID NO: 8298 - protein, 10 aa, Artificial Sequence
  Description of Artificial Sequence:  Synthetic Peptide
KMTASRPPRT

SEQ ID NO: 8299 - protein, 9 aa, Artificial Sequence
  Description of Artificial Sequence:  Synthetic Peptide
KMTASRPPR

SEQ ID NO: 8300 - protein, 9 aa, Artificial Sequence
  Description of Artificial Sequence:  Synthetic Peptide
SSLVMSNTR

SEQ ID NO: 8301 - protein, 9 aa, Artificial Sequence
  Description of Artificial Sequence:  Synthetic Peptide
ASRPPRTLR

SEQ ID NO: 8302 - protein, 9 aa, Artificial Sequence
  Description of Artificial Sequence:  Synthetic Peptide
CSCASTLVR

SEQ ID NO: 8303 - protein, 10 aa, Artificial Sequence
  Description of Artificial Sequence:  Synthetic Peptide
RVGCTTHMSK

SEQ ID NO: 8304 - protein, 10 aa, Artificial Sequence
  Description of Artificial Sequence:  Synthetic Peptide
RSSLVMSNTR

SEQ ID NO: 8305 - protein, 9 aa, Artificial Sequence
  Description of Artificial Sequence:  Synthetic Peptide
CASTLVRKY

SEQ ID NO: 8306 - protein, 10 aa, Artificial Sequence
  Description of Artificial Sequence:  Synthetic Peptide
SCASTLVRKY

SEQ ID NO: 8307 - protein, 9 aa, Artificial Sequence
  Description of Artificial Sequence:  Synthetic Peptide
TASRPPRTL

SEQ ID NO: 8308 - protein, 10 aa, Artificial Sequence
  Description of Artificial Sequence:  Synthetic Peptide
NTRVGCTTHM

SEQ ID NO: 8309 - protein, 9 aa, Artificial Sequence
  Description of Artificial Sequence:  Synthetic Peptide
VQLQAASSL

SEQ ID NO: 8310 - protein, 10 aa, Artificial Sequence
  Description of Artificial Sequence:  Synthetic Peptide
SLCSTPPTYI

SEQ ID NO: 8311 - protein, 10 aa, Artificial Sequence
  Description of Artificial Sequence:  Synthetic Peptide
MLDPTPYKYC

SEQ ID NO: 8312 - protein, 9 aa, Artificial Sequence
  Description of Artificial Sequence:  Synthetic Peptide
MLDPTPYKY

SEQ ID NO: 8313 - protein, 9 aa, Artificial Sequence
  Description of Artificial Sequence:  Synthetic Peptide
KYCTSTMFW

SEQ ID NO: 8314 - protein, 10 aa, Artificial Sequence
  Description of Artificial Sequence:  Synthetic Peptide
RSQRSPRVQL

SEQ ID NO: 8315 - protein, 10 aa, Artificial Sequence
  Description of Artificial Sequence:  Synthetic Peptide
RVQLQAASSL

SEQ ID NO: 8316 - protein, 10 aa, Artificial Sequence
  Description of Artificial Sequence:  Synthetic Peptide
PYKYCTSTMF

SEQ ID NO: 8317 - protein, 10 aa, Artificial Sequence
  Description of Artificial Sequence:  Synthetic Peptide
KYCTSTMFWW

SEQ ID NO: 8318 - protein, 9 aa, Artificial Sequence
  Description of Artificial Sequence:  Synthetic Peptide
TMFWWRWMR

SEQ ID NO: 8319 - protein, 9 aa, Artificial Sequence
  Description of Artificial Sequence:  Synthetic Peptide
AMLDPTPYK

SEQ ID NO: 8320 - protein, 9 aa, Artificial Sequence
  Description of Artificial Sequence:  Synthetic Peptide
MLDPTPYKY

SEQ ID NO: 8321 - protein, 10 aa, Artificial Sequence
  Description of Artificial Sequence:  Synthetic Peptide
AMLDPTPYKY

SEQ ID NO: 8322 - protein, 9 aa, Artificial Sequence
  Description of Artificial Sequence:  Synthetic Peptide
CTSTMFWWR

SEQ ID NO: 8323 - protein, 9 aa, Artificial Sequence
  Description of Artificial Sequence:  Synthetic Peptide
QTRASASRR

SEQ ID NO: 8324 - protein, 9 aa, Artificial Sequence
  Description of Artificial Sequence:  Synthetic Peptide
LSLSSRSQR

SEQ ID NO: 8325 - protein, 9 aa, Artificial Sequence
  Description of Artificial Sequence:  Synthetic Peptide
ASASRRNRR

SEQ ID NO: 8326 - protein, 9 aa, Artificial Sequence
  Description of Artificial Sequence:  Synthetic Peptide
EQTRASASR

SEQ ID NO: 8327 - protein, 9 aa, Artificial Sequence
  Description of Artificial Sequence:  Synthetic Peptide
SSDLSLSSR

SEQ ID NO: 8328 - protein, 9 aa, Artificial Sequence
  Description of Artificial Sequence:  Synthetic Peptide
SSRSQRSPR

SEQ ID NO: 8329 - protein, 9 aa, Artificial Sequence
  Description of Artificial Sequence:  Synthetic Peptide
TMFWWRWMR

SEQ ID NO: 8330 - protein, 10 aa, Artificial Sequence
  Description of Artificial Sequence:  Synthetic Peptide
STMFWWRWMR

SEQ ID NO: 8331 - protein, 10 aa, Artificial Sequence
  Description of Artificial Sequence:  Synthetic Peptide
DAMLDPTPYK

SEQ ID NO: 8332 - protein, 10 aa, Artificial Sequence
  Description of Artificial Sequence:  Synthetic Peptide
NIIHKQEQTR

SEQ ID NO: 8333 - protein, 10 aa, Artificial Sequence
  Description of Artificial Sequence:  Synthetic Peptide
EQTRASASRR

SEQ ID NO: 8334 - protein, 10 aa, Artificial Sequence
  Description of Artificial Sequence:  Synthetic Peptide
LSSDLSLSSR

SEQ ID NO: 8335 - protein, 10 aa, Artificial Sequence
  Description of Artificial Sequence:  Synthetic Peptide
DLSLSSRSQR

SEQ ID NO: 8336 - protein, 10 aa, Artificial Sequence
  Description of Artificial Sequence:  Synthetic Peptide
LSSRSQRSPR

SEQ ID NO: 8337 - protein, 10 aa, Artificial Sequence
  Description of Artificial Sequence:  Synthetic Peptide
PVDKAGRVVK

SEQ ID NO: 8338 - protein, 9 aa, Artificial Sequence
  Description of Artificial Sequence:  Synthetic Peptide
TPPTYILTL

SEQ ID NO: 8339 - protein, 9 aa, Artificial Sequence
  Description of Artificial Sequence:  Synthetic Peptide
RPVDKAGRV

SEQ ID NO: 8340 - protein, 10 aa, Artificial Sequence
  Description of Artificial Sequence:  Synthetic Peptide
TPYKYCTSTM

SEQ ID NO: 8341 - protein, 10 aa, Artificial Sequence
  Description of Artificial Sequence:  Synthetic Peptide
ASRRNRRTTY

SEQ ID NO: 8342 - protein, 10 aa, Artificial Sequence
  Description of Artificial Sequence:  Synthetic Peptide
RPVDKAGRVV

SEQ ID NO: 8343 - protein, 10 aa, Artificial Sequence
  Description of Artificial Sequence:  Synthetic Peptide
YSHLMAQDAM

SEQ ID NO: 8344 - protein, 10 aa, Artificial Sequence
  Description of Artificial Sequence:  Synthetic Peptide
TSTMFWWRWM

SEQ ID NO: 8345 - protein, 10 aa, Artificial Sequence
  Description of Artificial Sequence:  Synthetic Peptide
RSQRSPRVQL

SEQ ID NO: 8346 - protein, 10 aa, Artificial Sequence
  Description of Artificial Sequence:  Synthetic Peptide
SSLCSTPPTY

SEQ ID NO: 8347 - protein, 9 aa, Artificial Sequence
  Description of Artificial Sequence:  Synthetic Peptide
DAMLDPTPY

SEQ ID NO: 8348 - protein, 10 aa, Artificial Sequence
  Description of Artificial Sequence:  Synthetic Peptide
QDAMLDPTPY

SEQ ID NO: 8349 - protein, 10 aa, Artificial Sequence
  Description of Artificial Sequence:  Synthetic Peptide
SSLCSTPPTY

SEQ ID NO: 8350 - protein, 9 aa, Artificial Sequence
  Description of Artificial Sequence:  Synthetic Peptide
SQRSPRVQL

SEQ ID NO: 8351 - protein, 9 aa, Artificial Sequence
  Description of Artificial Sequence:  Synthetic Peptide
TPPTYILTL

SEQ ID NO: 8352 - protein, 9 aa, Artificial Sequence
  Description of Artificial Sequence:  Synthetic Peptide
CVVDSSNGL

SEQ ID NO: 8353 - protein, 9 aa, Artificial Sequence
  Description of Artificial Sequence:  Synthetic Peptide
SPRVQLQAA

SEQ ID NO: 8354 - protein, 9 aa, Artificial Sequence
  Description of Artificial Sequence:  Synthetic Peptide
HLMAQDAML

SEQ ID NO: 8355 - protein, 10 aa, Artificial Sequence
  Description of Artificial Sequence:  Synthetic Peptide
RNRRTTYSHL

SEQ ID NO: 8356 - protein, 10 aa, Artificial Sequence
  Description of Artificial Sequence:  Synthetic Peptide
TPYKYCTSTM

SEQ ID NO: 8357 - protein, 10 aa, Artificial Sequence
  Description of Artificial Sequence:  Synthetic Peptide
RVQLQAASSL

SEQ ID NO: 8358 - protein, 10 aa, Artificial Sequence
  Description of Artificial Sequence:  Synthetic Peptide
SSRSQRSPRV

SEQ ID NO: 8359 - protein, 9 aa, Artificial Sequence
  Description of Artificial Sequence:  Synthetic Peptide
VLLRTKTSV

SEQ ID NO: 8360 - protein, 9 aa, Artificial Sequence
  Description of Artificial Sequence:  Synthetic Peptide
TLVNPVEFI

SEQ ID NO: 8361 - protein, 9 aa, Artificial Sequence
  Description of Artificial Sequence:  Synthetic Peptide
VLLPTPPMT

SEQ ID NO: 8362 - protein, 9 aa, Artificial Sequence
  Description of Artificial Sequence:  Synthetic Peptide
KQSVGQSKV

SEQ ID NO: 8363 - protein, 9 aa, Artificial Sequence
  Description of Artificial Sequence:  Synthetic Peptide
FIQVQPNQL

SEQ ID NO: 8364 - protein, 10 aa, Artificial Sequence
  Description of Artificial Sequence:  Synthetic Peptide
QLPSGGLVLL

SEQ ID NO: 8365 - protein, 10 aa, Artificial Sequence
  Description of Artificial Sequence:  Synthetic Peptide
LVLLRTKTSV

SEQ ID NO: 8366 - protein, 10 aa, Artificial Sequence
  Description of Artificial Sequence:  Synthetic Peptide
LVNPVEFIQV

SEQ ID NO: 8367 - protein, 10 aa, Artificial Sequence
  Description of Artificial Sequence:  Synthetic Peptide
EFIQVQPNQL

SEQ ID NO: 8368 - protein, 9 aa, Artificial Sequence
  Description of Artificial Sequence:  Synthetic Peptide
YVASGCLRK

SEQ ID NO: 8369 - protein, 9 aa, Artificial Sequence
  Description of Artificial Sequence:  Synthetic Peptide
VIQGPEPHR

SEQ ID NO: 8370 - protein, 10 aa, Artificial Sequence
  Description of Artificial Sequence:  Synthetic Peptide
GVIQGPEPHR

SEQ ID NO: 8371 - protein, 9 aa, Artificial Sequence
  Description of Artificial Sequence:  Synthetic Peptide
LPSGGLVLL

SEQ ID NO: 8372 - protein, 10 aa, Artificial Sequence
  Description of Artificial Sequence:  Synthetic Peptide
QPNQLPSGGL

SEQ ID NO: 8373 - protein, 9 aa, Artificial Sequence
  Description of Artificial Sequence:  Synthetic Peptide
LPSGGLVLL

SEQ ID NO: 8374 - protein, 9 aa, Artificial Sequence
  Description of Artificial Sequence:  Synthetic Peptide
SVGQSKVLL

SEQ ID NO: 8375 - protein, 9 aa, Artificial Sequence
  Description of Artificial Sequence:  Synthetic Peptide
APHTLVNPV

SEQ ID NO: 8376 - protein, 10 aa, Artificial Sequence
  Description of Artificial Sequence:  Synthetic Peptide
QPNQLPSGGL

SEQ ID NO: 8377 - protein, 9 aa, Artificial Sequence
  Description of Artificial Sequence:  Synthetic Peptide
WMFCLAPGV

SEQ ID NO: 8378 - protein, 9 aa, Artificial Sequence
  Description of Artificial Sequence:  Synthetic Peptide
VLISWMFCL

SEQ ID NO: 8379 - protein, 9 aa, Artificial Sequence
  Description of Artificial Sequence:  Synthetic Peptide
LVLISWMFC

SEQ ID NO: 8380 - protein, 10 aa, Artificial Sequence
  Description of Artificial Sequence:  Synthetic Peptide
LVLISWMFCL

SEQ ID NO: 8381 - protein, 10 aa, Artificial Sequence
  Description of Artificial Sequence:  Synthetic Peptide
QLPLVLISWM

SEQ ID NO: 8382 - protein, 10 aa, Artificial Sequence
  Description of Artificial Sequence:  Synthetic Peptide
VLISWMFCLA

SEQ ID NO: 8383 - protein, 10 aa, Artificial Sequence
  Description of Artificial Sequence:  Synthetic Peptide
AVVRPAFPPV

SEQ ID NO: 8384 - protein, 10 aa, Artificial Sequence
  Description of Artificial Sequence:  Synthetic Peptide
AQFPTMEKYA

SEQ ID NO: 8385 - protein, 9 aa, Artificial Sequence
  Description of Artificial Sequence:  Synthetic Peptide
VLISWMFCL

SEQ ID NO: 8386 - protein, 9 aa, Artificial Sequence
  Description of Artificial Sequence:  Synthetic Peptide
FCLAPGVRR

SEQ ID NO: 8387 - protein, 9 aa, Artificial Sequence
  Description of Artificial Sequence:  Synthetic Peptide
FPTMEKYAM

SEQ ID NO: 8388 - protein, 9 aa, Artificial Sequence
  Description of Artificial Sequence:  Synthetic Peptide
LPLVLISWM

SEQ ID NO: 8389 - protein, 9 aa, Artificial Sequence
  Description of Artificial Sequence:  Synthetic Peptide
SPAVVRPAF

SEQ ID NO: 8390 - protein, 9 aa, Artificial Sequence
  Description of Artificial Sequence:  Synthetic Peptide
RPAFPPVTW

SEQ ID NO: 8391 - protein, 10 aa, Artificial Sequence
  Description of Artificial Sequence:  Synthetic Peptide
LPLVLISWMF

SEQ ID NO: 8392 - protein, 9 aa, Artificial Sequence
  Description of Artificial Sequence:  Synthetic Peptide
LPLVLISWM

SEQ ID NO: 8393 - protein, 9 aa, Artificial Sequence
  Description of Artificial Sequence:  Synthetic Peptide
FPTMEKYAM

SEQ ID NO: 8394 - protein, 9 aa, Artificial Sequence
  Description of Artificial Sequence:  Synthetic Peptide
VVRPAFPPV

SEQ ID NO: 8395 - protein, 10 aa, Artificial Sequence
  Description of Artificial Sequence:  Synthetic Peptide
LVLISWMFCL

SEQ ID NO: 8396 - protein, 10 aa, Artificial Sequence
  Description of Artificial Sequence:  Synthetic Peptide
GVRRPTSPAV

SEQ ID NO: 8397 - protein, 9 aa, Artificial Sequence
  Description of Artificial Sequence:  Synthetic Peptide
MSMMACGIR

SEQ ID NO: 8398 - protein, 9 aa, Artificial Sequence
  Description of Artificial Sequence:  Synthetic Peptide
TILELGQSL

SEQ ID NO: 8399 - protein, 10 aa, Artificial Sequence
  Description of Artificial Sequence:  Synthetic Peptide
TILELGQSLV

SEQ ID NO: 8400 - protein, 9 aa, Artificial Sequence
  Description of Artificial Sequence:  Synthetic Peptide
TILELGQSL

SEQ ID NO: 8401 - protein, 9 aa, Artificial Sequence
  Description of Artificial Sequence:  Synthetic Peptide
LELGQSLVT

SEQ ID NO: 8402 - protein, 10 aa, Artificial Sequence
  Description of Artificial Sequence:  Synthetic Peptide
LELGQSLVTW

SEQ ID NO: 8403 - protein, 9 aa, Artificial Sequence
  Description of Artificial Sequence:  Synthetic Peptide
AASYTILEL

SEQ ID NO: 8404 - protein, 9 aa, Artificial Sequence
  Description of Artificial Sequence:  Synthetic Peptide
ASAASYTIL

SEQ ID NO: 8405 - protein, 10 aa, Artificial Sequence
  Description of Artificial Sequence:  Synthetic Peptide
MASAASYTIL

SEQ ID NO: 8406 - protein, 10 aa, Artificial Sequence
  Description of Artificial Sequence:  Synthetic Peptide
SAASYTILEL

SEQ ID NO: 8407 - protein, 10 aa, Artificial Sequence
  Description of Artificial Sequence:  Synthetic Peptide
KPHVRVSMTL

SEQ ID NO: 8408 - protein, 9 aa, Artificial Sequence
  Description of Artificial Sequence:  Synthetic Peptide
VSMTLPKLR

SEQ ID NO: 8409 - protein, 9 aa, Artificial Sequence
  Description of Artificial Sequence:  Synthetic Peptide
GSVGPQLGR

SEQ ID NO: 8410 - protein, 10 aa, Artificial Sequence
  Description of Artificial Sequence:  Synthetic Peptide
RVSMTLPKLR

SEQ ID NO: 8411 - protein, 10 aa, Artificial Sequence
  Description of Artificial Sequence:  Synthetic Peptide
MTLPKLRDLR

SEQ ID NO: 8412 - protein, 10 aa, Artificial Sequence
  Description of Artificial Sequence:  Synthetic Peptide
HVRVSMTLPK

SEQ ID NO: 8413 - protein, 10 aa, Artificial Sequence
  Description of Artificial Sequence:  Synthetic Peptide
QLGREPRGDR

SEQ ID NO: 8414 - protein, 9 aa, Artificial Sequence
  Description of Artificial Sequence:  Synthetic Peptide
HPAHPQPSL

SEQ ID NO: 8415 - protein, 10 aa, Artificial Sequence
  Description of Artificial Sequence:  Synthetic Peptide
KPHVRVSMTL

SEQ ID NO: 8416 - protein, 10 aa, Artificial Sequence
  Description of Artificial Sequence:  Synthetic Peptide
SAKPHVRVSM

SEQ ID NO: 8417 - protein, 9 aa, Artificial Sequence
  Description of Artificial Sequence:  Synthetic Peptide
HPAHPQPSL

SEQ ID NO: 8418 - protein, 9 aa, Artificial Sequence
  Description of Artificial Sequence:  Synthetic Peptide
RVSMTLPKL

SEQ ID NO: 8419 - protein, 10 aa, Artificial Sequence
  Description of Artificial Sequence:  Synthetic Peptide
KPHVRVSMTL

SEQ ID NO: 8420 - protein, 10 aa, Artificial Sequence
  Description of Artificial Sequence:  Synthetic Peptide
EPRGDRSHPA

SEQ ID NO: 8421 - protein, 10 aa, Artificial Sequence
  Description of Artificial Sequence:  Synthetic Peptide
YPMRSAKPHV

SEQ ID NO: 8422 - protein, 10 aa, Artificial Sequence
  Description of Artificial Sequence:  Synthetic Peptide
EPRGDRSHPA

SEQ ID NO: 8423 - protein, 10 aa, Artificial Sequence
  Description of Artificial Sequence:  Synthetic Peptide
KLRDLRRGSV

SEQ ID NO: 8424 - protein, 10 aa, Artificial Sequence
  Description of Artificial Sequence:  Synthetic Peptide
GLSRPNTTRL

SEQ ID NO: 8425 - protein, 9 aa, Artificial Sequence
  Description of Artificial Sequence:  Synthetic Peptide
PYQAVPQGL

SEQ ID NO: 8426 - protein, 10 aa, Artificial Sequence
  Description of Artificial Sequence:  Synthetic Peptide
RPNTTRLAVL

SEQ ID NO: 8427 - protein, 9 aa, Artificial Sequence
  Description of Artificial Sequence:  Synthetic Peptide
GLSRPNTTR

SEQ ID NO: 8428 - protein, 10 aa, Artificial Sequence
  Description of Artificial Sequence:  Synthetic Peptide
VLRGHAQISR

SEQ ID NO: 8429 - protein, 9 aa, Artificial Sequence
  Description of Artificial Sequence:  Synthetic Peptide
NTTRLAVLR

SEQ ID NO: 8430 - protein, 9 aa, Artificial Sequence
  Description of Artificial Sequence:  Synthetic Peptide
QAVPQGLSR

SEQ ID NO: 8431 - protein, 10 aa, Artificial Sequence
  Description of Artificial Sequence:  Synthetic Peptide
YQAVPQGLSR

SEQ ID NO: 8432 - protein, 9 aa, Artificial Sequence
  Description of Artificial Sequence:  Synthetic Peptide
LPGHSQAPY

SEQ ID NO: 8433 - protein, 9 aa, Artificial Sequence
  Description of Artificial Sequence:  Synthetic Peptide
LSRPNTTRL

SEQ ID NO: 8434 - protein, 10 aa, Artificial Sequence
  Description of Artificial Sequence:  Synthetic Peptide
RPNTTRLAVL

SEQ ID NO: 8435 - protein, 10 aa, Artificial Sequence
  Description of Artificial Sequence:  Synthetic Peptide
APYQAVPQGL

SEQ ID NO: 8436 - protein, 9 aa, Artificial Sequence
  Description of Artificial Sequence:  Synthetic Peptide
LSRPNTTRL

SEQ ID NO: 8437 - protein, 10 aa, Artificial Sequence
  Description of Artificial Sequence:  Synthetic Peptide
APYQAVPQGL

SEQ ID NO: 8438 - protein, 10 aa, Artificial Sequence
  Description of Artificial Sequence:  Synthetic Peptide
RPNTTRLAVL

SEQ ID NO: 8439 - protein, 9 aa, Artificial Sequence
  Description of Artificial Sequence:  Synthetic Peptide
RLTDLSQLA

SEQ ID NO: 8440 - protein, 10 aa, Artificial Sequence
  Description of Artificial Sequence:  Synthetic Peptide
RLTDLSQLAV

SEQ ID NO: 8441 - protein, 10 aa, Artificial Sequence
  Description of Artificial Sequence:  Synthetic Peptide
KMEPPLKKGK

SEQ ID NO: 8442 - protein, 9 aa, Artificial Sequence
  Description of Artificial Sequence:  Synthetic Peptide
KWLKRPECL

SEQ ID NO: 8443 - protein, 10 aa, Artificial Sequence
  Description of Artificial Sequence:  Synthetic Peptide
KMEPPLKKGK

SEQ ID NO: 8444 - protein, 9 aa, Artificial Sequence
  Description of Artificial Sequence:  Synthetic Peptide
DLSQLAVTR

SEQ ID NO: 8445 - protein, 9 aa, Artificial Sequence
  Description of Artificial Sequence:  Synthetic Peptide
EPPLKKGKR

SEQ ID NO: 8446 - protein, 10 aa, Artificial Sequence
  Description of Artificial Sequence:  Synthetic Peptide
SSVGEEVDAY

SEQ ID NO: 8447 - protein, 9 aa, Artificial Sequence
  Description of Artificial Sequence:  Synthetic Peptide
EEVDAYPCS

SEQ ID NO: 8448 - protein, 10 aa, Artificial Sequence
  Description of Artificial Sequence:  Synthetic Peptide
SSVGEEVDAY

SEQ ID NO: 8449 - protein, 10 aa, Artificial Sequence
  Description of Artificial Sequence:  Synthetic Peptide
VTRAKMEPPL

SEQ ID NO: 8450 - protein, 9 aa, Artificial Sequence
  Description of Artificial Sequence:  Synthetic Peptide
FELCSYCPV

SEQ ID NO: 8451 - protein, 9 aa, Artificial Sequence
  Description of Artificial Sequence:  Synthetic Peptide
WSEFELCSY

SEQ ID NO: 8452 - protein, 9 aa, Artificial Sequence
  Description of Artificial Sequence:  Synthetic Peptide
SYCPVEEVL

SEQ ID NO: 8453 - protein, 9 aa, Artificial Sequence
  Description of Artificial Sequence:  Synthetic Peptide
RYWSEFELC

SEQ ID NO: 8454 - protein, 10 aa, Artificial Sequence
  Description of Artificial Sequence:  Synthetic Peptide
KFSEACGHPI

SEQ ID NO: 8455 - protein, 10 aa, Artificial Sequence
  Description of Artificial Sequence:  Synthetic Peptide
RYWSEFELCS

SEQ ID NO: 8456 - protein, 9 aa, Artificial Sequence
  Description of Artificial Sequence:  Synthetic Peptide
NVSPAVASR

SEQ ID NO: 8457 - protein, 9 aa, Artificial Sequence
  Description of Artificial Sequence:  Synthetic Peptide
PVSPSSQGR

SEQ ID NO: 8458 - protein, 9 aa, Artificial Sequence
  Description of Artificial Sequence:  Synthetic Peptide
GQVQPASGR

SEQ ID NO: 8459 - protein, 10 aa, Artificial Sequence
  Description of Artificial Sequence:  Synthetic Peptide
EVLATYGSPA

SEQ ID NO: 8460 - protein, 10 aa, Artificial Sequence
  Description of Artificial Sequence:  Synthetic Peptide
GPVSPSSQGR

SEQ ID NO: 8461 - protein, 10 aa, Artificial Sequence
  Description of Artificial Sequence:  Synthetic Peptide
CPVEEVLATY

SEQ ID NO: 8462 - protein, 9 aa, Artificial Sequence
  Description of Artificial Sequence:  Synthetic Peptide
EEVLATYGS

SEQ ID NO: 8463 - protein, 10 aa, Artificial Sequence
  Description of Artificial Sequence:  Synthetic Peptide
SEACGHPIDF

SEQ ID NO: 8464 - protein, 10 aa, Artificial Sequence
  Description of Artificial Sequence:  Synthetic Peptide
CPVEEVLATY

SEQ ID NO: 8465 - protein, 10 aa, Artificial Sequence
  Description of Artificial Sequence:  Synthetic Peptide
REPTGQVQPA

SEQ ID NO: 8466 - protein, 10 aa, Artificial Sequence
  Description of Artificial Sequence:  Synthetic Peptide
ADAPGPVSPS

SEQ ID NO: 8467 - protein, 10 aa, Artificial Sequence
  Description of Artificial Sequence:  Synthetic Peptide
SGRYWSEFEL

SEQ ID NO: 8468 - protein, 10 aa, Artificial Sequence
  Description of Artificial Sequence:  Synthetic Peptide
RPQCGGKHDY

SEQ ID NO: 8469 - protein, 10 aa, Artificial Sequence
  Description of Artificial Sequence:  Synthetic Peptide
ATDVFCPIAK

SEQ ID NO: 8470 - protein, 10 aa, Artificial Sequence
  Description of Artificial Sequence:  Synthetic Peptide
VFCPIAKLGF

SEQ ID NO: 8471 - protein, 9 aa, Artificial Sequence
  Description of Artificial Sequence:  Synthetic Peptide
DVFCPIAKL

SEQ ID NO: 8472 - protein, 10 aa, Artificial Sequence
  Description of Artificial Sequence:  Synthetic Peptide
ATDVFCPIAK

SEQ ID NO: 8473 - protein, 9 aa, Artificial Sequence
  Description of Artificial Sequence:  Synthetic Peptide
DVFCPIAKL

SEQ ID NO: 8474 - protein, 9 aa, Artificial Sequence
  Description of Artificial Sequence:  Synthetic Peptide
WGRQAASFL

SEQ ID NO: 8475 - protein, 9 aa, Artificial Sequence
  Description of Artificial Sequence:  Synthetic Peptide
FLLPLASTA

SEQ ID NO: 8476 - protein, 10 aa, Artificial Sequence
  Description of Artificial Sequence:  Synthetic Peptide
NLQSVKCDFL

SEQ ID NO: 8477 - protein, 10 aa, Artificial Sequence
  Description of Artificial Sequence:  Synthetic Peptide
LQSVKCDFLL

SEQ ID NO: 8478 - protein, 9 aa, Artificial Sequence
  Description of Artificial Sequence:  Synthetic Peptide
AVQNLQSVK

SEQ ID NO: 8479 - protein, 10 aa, Artificial Sequence
  Description of Artificial Sequence:  Synthetic Peptide
SVKCDFLLPL

SEQ ID NO: 8480 - protein, 9 aa, Artificial Sequence
  Description of Artificial Sequence:  Synthetic Peptide
FVVRLFPRL

SEQ ID NO: 8481 - protein, 10 aa, Artificial Sequence
  Description of Artificial Sequence:  Synthetic Peptide
WFVVRLFPRL

SEQ ID NO: 8482 - protein, 9 aa, Artificial Sequence
  Description of Artificial Sequence:  Synthetic Peptide
FVVRLFPRL

SEQ ID NO: 8483 - protein, 9 aa, Artificial Sequence
  Description of Artificial Sequence:  Synthetic Peptide
ASRGAGHRR

SEQ ID NO: 8484 - protein, 10 aa, Artificial Sequence
  Description of Artificial Sequence:  Synthetic Peptide
MVGGASCLER

SEQ ID NO: 8485 - protein, 10 aa, Artificial Sequence
  Description of Artificial Sequence:  Synthetic Peptide
QLASRGAGHR

SEQ ID NO: 8486 - protein, 10 aa, Artificial Sequence
  Description of Artificial Sequence:  Synthetic Peptide
RQHGYVRFGL

SEQ ID NO: 8487 - protein, 10 aa, Artificial Sequence
  Description of Artificial Sequence:  Synthetic Peptide
ISEHGRQHGY

SEQ ID NO: 8488 - protein, 10 aa, Artificial Sequence
  Description of Artificial Sequence:  Synthetic Peptide
RQHGYVRFGL

SEQ ID NO: 8489 - protein, 9 aa, Artificial Sequence
  Description of Artificial Sequence:  Synthetic Peptide
SEHGRQHGY

SEQ ID NO: 8490 - protein, 10 aa, Artificial Sequence
  Description of Artificial Sequence:  Synthetic Peptide
SEHGRQHGYV

SEQ ID NO: 8491 - protein, 10 aa, Artificial Sequence
  Description of Artificial Sequence:  Synthetic Peptide
KVAQHLAYPV

SEQ ID NO: 8492 - protein, 10 aa, Artificial Sequence
  Description of Artificial Sequence:  Synthetic Peptide
GLKVAQHLAY

SEQ ID NO: 8493 - protein, 9 aa, Artificial Sequence
  Description of Artificial Sequence:  Synthetic Peptide
ELGFQPGLK

SEQ ID NO: 8494 - protein, 9 aa, Artificial Sequence
  Description of Artificial Sequence:  Synthetic Peptide
LAGHKGNPR

SEQ ID NO: 8495 - protein, 10 aa, Artificial Sequence
  Description of Artificial Sequence:  Synthetic Peptide
ALAGHKGNPR

SEQ ID NO: 8496 - protein, 9 aa, Artificial Sequence
  Description of Artificial Sequence:  Synthetic Peptide
NPRQLWHEL

SEQ ID NO: 8497 - protein, 10 aa, Artificial Sequence
  Description of Artificial Sequence:  Synthetic Peptide
QPGLKVAQHL

SEQ ID NO: 8498 - protein, 10 aa, Artificial Sequence
  Description of Artificial Sequence:  Synthetic Peptide
SSPDPPIPAL

SEQ ID NO: 8499 - protein, 9 aa, Artificial Sequence
  Description of Artificial Sequence:  Synthetic Peptide
HELGFQPGL

SEQ ID NO: 8500 - protein, 9 aa, Artificial Sequence
  Description of Artificial Sequence:  Synthetic Peptide
NPRQLWHEL

SEQ ID NO: 8501 - protein, 9 aa, Artificial Sequence
  Description of Artificial Sequence:  Synthetic Peptide
SPDPPIPAL

SEQ ID NO: 8502 - protein, 10 aa, Artificial Sequence
  Description of Artificial Sequence:  Synthetic Peptide
QPGLKVAQHL

SEQ ID NO: 8503 - protein, 10 aa, Artificial Sequence
  Description of Artificial Sequence:  Synthetic Peptide
AGHKGNPRQL

SEQ ID NO: 8504 - protein, 9 aa, Artificial Sequence
  Description of Artificial Sequence:  Synthetic Peptide
NPRQLWHEL

SEQ ID NO: 8505 - protein, 10 aa, Artificial Sequence
  Description of Artificial Sequence:  Synthetic Peptide
EYGSDAGGCI

SEQ ID NO: 8506 - protein, 9 aa, Artificial Sequence
  Description of Artificial Sequence:  Synthetic Peptide
DAGGCIALR

SEQ ID NO: 8507 - protein, 9 aa, Artificial Sequence
  Description of Artificial Sequence:  Synthetic Peptide
CIALRHVVR

SEQ ID NO: 8508 - protein, 10 aa, Artificial Sequence
  Description of Artificial Sequence:  Synthetic Peptide
GCIALRHVVR

SEQ ID NO: 8509 - protein, 9 aa, Artificial Sequence
  Description of Artificial Sequence:  Synthetic Peptide
QELGYSEAA

SEQ ID NO: 8510 - protein, 10 aa, Artificial Sequence
  Description of Artificial Sequence:  Synthetic Peptide
AEYGSDAGGC

SEQ ID NO: 8511 - protein, 10 aa, Artificial Sequence
  Description of Artificial Sequence:  Synthetic Peptide
SEAAEYGSDA

SEQ ID NO: 8512 - protein, 9 aa, Artificial Sequence
  Description of Artificial Sequence:  Synthetic Peptide
LLSEHHPLL

SEQ ID NO: 8513 - protein, 9 aa, Artificial Sequence
  Description of Artificial Sequence:  Synthetic Peptide
GLQEAEGLL

SEQ ID NO: 8514 - protein, 10 aa, Artificial Sequence
  Description of Artificial Sequence:  Synthetic Peptide
GLQEAEGLLL

SEQ ID NO: 8515 - protein, 9 aa, Artificial Sequence
  Description of Artificial Sequence:  Synthetic Peptide
RGLQEAEGL

SEQ ID NO: 8516 - protein, 10 aa, Artificial Sequence
  Description of Artificial Sequence:  Synthetic Peptide
RGLQEAEGLL

SEQ ID NO: 8517 - protein, 9 aa, Artificial Sequence
  Description of Artificial Sequence:  Synthetic Peptide
AEGLLLELL

SEQ ID NO: 8518 - protein, 9 aa, Artificial Sequence
  Description of Artificial Sequence:  Synthetic Peptide
SEHHPLLDV

SEQ ID NO: 8519 - protein, 10 aa, Artificial Sequence
  Description of Artificial Sequence:  Synthetic Peptide
QEAEGLLLEL

SEQ ID NO: 8520 - protein, 9 aa, Artificial Sequence
  Description of Artificial Sequence:  Synthetic Peptide
KVLPTLLCL

SEQ ID NO: 8521 - protein, 10 aa, Artificial Sequence
  Description of Artificial Sequence:  Synthetic Peptide
GLVRYQVRKV

SEQ ID NO: 8522 - protein, 10 aa, Artificial Sequence
  Description of Artificial Sequence:  Synthetic Peptide
YQVRKVLPTL

SEQ ID NO: 8523 - protein, 9 aa, Artificial Sequence
  Description of Artificial Sequence:  Synthetic Peptide
KVLPTLLCL

SEQ ID NO: 8524 - protein, 10 aa, Artificial Sequence
  Description of Artificial Sequence:  Synthetic Peptide
RYQVRKVLPT

SEQ ID NO: 8525 - protein, 9 aa, Artificial Sequence
  Description of Artificial Sequence:  Synthetic Peptide
GLVRYQVRK

SEQ ID NO: 8526 - protein, 9 aa, Artificial Sequence
  Description of Artificial Sequence:  Synthetic Peptide
QTLPHLVPR

SEQ ID NO: 8527 - protein, 9 aa, Artificial Sequence
  Description of Artificial Sequence:  Synthetic Peptide
KVLPTLLCL

SEQ ID NO: 8528 - protein, 10 aa, Artificial Sequence
  Description of Artificial Sequence:  Synthetic Peptide
DQTLPHLVPR

SEQ ID NO: 8529 - protein, 9 aa, Artificial Sequence
  Description of Artificial Sequence:  Synthetic Peptide
SAHGGLVRY

SEQ ID NO: 8530 - protein, 10 aa, Artificial Sequence
  Description of Artificial Sequence:  Synthetic Peptide
MEGGFKADQT

SEQ ID NO: 8531 - protein, 9 aa, Artificial Sequence
  Description of Artificial Sequence:  Synthetic Peptide
QVRKVLPTL

SEQ ID NO: 8532 - protein, 9 aa, Artificial Sequence
  Description of Artificial Sequence:  Synthetic Peptide
LVPRWGRGL

SEQ ID NO: 8533 - protein, 9 aa, Artificial Sequence
  Description of Artificial Sequence:  Synthetic Peptide
KVLPTLLCL

SEQ ID NO: 8534 - protein, 9 aa, Artificial Sequence
  Description of Artificial Sequence:  Synthetic Peptide
LVRYQVRKV

SEQ ID NO: 8535 - protein, 10 aa, Artificial Sequence
  Description of Artificial Sequence:  Synthetic Peptide
LVRYQVRKVL

SEQ ID NO: 8536 - protein, 10 aa, Artificial Sequence
  Description of Artificial Sequence:  Synthetic Peptide
QVRKVLPTLL

SEQ ID NO: 8537 - protein, 9 aa, Artificial Sequence
  Description of Artificial Sequence:  Synthetic Peptide
ALPKFKMVL

SEQ ID NO: 8538 - protein, 10 aa, Artificial Sequence
  Description of Artificial Sequence:  Synthetic Peptide
VLAHGKPRGV

SEQ ID NO: 8539 - protein, 10 aa, Artificial Sequence
  Description of Artificial Sequence:  Synthetic Peptide
ALPKFKMVLA

SEQ ID NO: 8540 - protein, 9 aa, Artificial Sequence
  Description of Artificial Sequence:  Synthetic Peptide
MVLAHGKPR

SEQ ID NO: 8541 - protein, 10 aa, Artificial Sequence
  Description of Artificial Sequence:  Synthetic Peptide
KMVLAHGKPR

SEQ ID NO: 8542 - protein, 9 aa, Artificial Sequence
  Description of Artificial Sequence:  Synthetic Peptide
KPRGVHVRS

SEQ ID NO: 8543 - protein, 9 aa, Artificial Sequence
  Description of Artificial Sequence:  Synthetic Peptide
ALPKFKMVL

SEQ ID NO: 8544 - protein, 10 aa, Artificial Sequence
  Description of Artificial Sequence:  Synthetic Peptide
DALPKFKMVL

SEQ ID NO: 8545 - protein, 9 aa, Artificial Sequence
  Description of Artificial Sequence:  Synthetic Peptide
LPKFKMVLA

SEQ ID NO: 8546 - protein, 9 aa, Artificial Sequence
  Description of Artificial Sequence:  Synthetic Peptide
VALVTNYYV

SEQ ID NO: 8547 - protein, 10 aa, Artificial Sequence
  Description of Artificial Sequence:  Synthetic Peptide
GVALVTNYYV

SEQ ID NO: 8548 - protein, 10 aa, Artificial Sequence
  Description of Artificial Sequence:  Synthetic Peptide
HLEGDSLAVK

SEQ ID NO: 8549 - protein, 10 aa, Artificial Sequence
  Description of Artificial Sequence:  Synthetic Peptide
HLEGDSLAVK

SEQ ID NO: 8550 - protein, 9 aa, Artificial Sequence
  Description of Artificial Sequence:  Synthetic Peptide
SSGEHNQSR

SEQ ID NO: 8551 - protein, 9 aa, Artificial Sequence
  Description of Artificial Sequence:  Synthetic Peptide
RMGHSDGAR

SEQ ID NO: 8552 - protein, 9 aa, Artificial Sequence
  Description of Artificial Sequence:  Synthetic Peptide
DAQDGCGIR

SEQ ID NO: 8553 - protein, 10 aa, Artificial Sequence
  Description of Artificial Sequence:  Synthetic Peptide
GSSGEHNQSR

SEQ ID NO: 8554 - protein, 10 aa, Artificial Sequence
  Description of Artificial Sequence:  Synthetic Peptide
DVRMGHSDGA

SEQ ID NO: 8555 - protein, 10 aa, Artificial Sequence
  Description of Artificial Sequence:  Synthetic Peptide
RMGHSDGARR

SEQ ID NO: 8556 - protein, 9 aa, Artificial Sequence
  Description of Artificial Sequence:  Synthetic Peptide
QSRPRSLCL

SEQ ID NO: 8557 - protein, 9 aa, Artificial Sequence
  Description of Artificial Sequence:  Synthetic Peptide
QSNLLDVRM

SEQ ID NO: 8558 - protein, 9 aa, Artificial Sequence
  Description of Artificial Sequence:  Synthetic Peptide
RGVALVTNY

SEQ ID NO: 8559 - protein, 10 aa, Artificial Sequence
  Description of Artificial Sequence:  Synthetic Peptide
RGVALVTNYY

SEQ ID NO: 8560 - protein, 9 aa, Artificial Sequence
  Description of Artificial Sequence:  Synthetic Peptide
QSRPRSLCL

SEQ ID NO: 8561 - protein, 9 aa, Artificial Sequence
  Description of Artificial Sequence:  Synthetic Peptide
QSRPRSLCL

SEQ ID NO: 8562 - protein, 9 aa, Artificial Sequence
  Description of Artificial Sequence:  Synthetic Peptide
GCGIRGVAL

SEQ ID NO: 8563 - protein, 10 aa, Artificial Sequence
  Description of Artificial Sequence:  Synthetic Peptide
ALGHCWWRGV

SEQ ID NO: 8564 - protein, 10 aa, Artificial Sequence
  Description of Artificial Sequence:  Synthetic Peptide
SMQVGHLEAL

SEQ ID NO: 8565 - protein, 9 aa, Artificial Sequence
  Description of Artificial Sequence:  Synthetic Peptide
EALGHCWWR

SEQ ID NO: 8566 - protein, 9 aa, Artificial Sequence
  Description of Artificial Sequence:  Synthetic Peptide
HLVALGCVR

SEQ ID NO: 8567 - protein, 9 aa, Artificial Sequence
  Description of Artificial Sequence:  Synthetic Peptide
VALGCVRSR

SEQ ID NO: 8568 - protein, 10 aa, Artificial Sequence
  Description of Artificial Sequence:  Synthetic Peptide
LVALGCVRSR

SEQ ID NO: 8569 - protein, 10 aa, Artificial Sequence
  Description of Artificial Sequence:  Synthetic Peptide
STKAQRCSNR

SEQ ID NO: 8570 - protein, 9 aa, Artificial Sequence
  Description of Artificial Sequence:  Synthetic Peptide
LEALGHCWW

SEQ ID NO: 8571 - protein, 10 aa, Artificial Sequence
  Description of Artificial Sequence:  Synthetic Peptide
CVRSRDLGAL

SEQ ID NO: 8572 - protein, 10 aa, Artificial Sequence
  Description of Artificial Sequence:  Synthetic Peptide
SNRGVEHQHL

SEQ ID NO: 8573 - protein, 10 aa, Artificial Sequence
  Description of Artificial Sequence:  Synthetic Peptide
ALGCVRSRDL

SEQ ID NO: 8574 - protein, 10 aa, Artificial Sequence
  Description of Artificial Sequence:  Synthetic Peptide
AGGSMQVGHL

SEQ ID NO: 8575 - protein, 9 aa, Artificial Sequence
  Description of Artificial Sequence:  Synthetic Peptide
MVIHIGASK

SEQ ID NO: 8576 - protein, 10 aa, Artificial Sequence
  Description of Artificial Sequence:  Synthetic Peptide
MVIHIGASKR

SEQ ID NO: 8577 - protein, 9 aa, Artificial Sequence
  Description of Artificial Sequence:  Synthetic Peptide
VAHPSDDTR

SEQ ID NO: 8578 - protein, 10 aa, Artificial Sequence
  Description of Artificial Sequence:  Synthetic Peptide
VVAHPSDDTR

SEQ ID NO: 8579 - protein, 10 aa, Artificial Sequence
  Description of Artificial Sequence:  Synthetic Peptide
AEQGVVAHPS

SEQ ID NO: 8580 - protein, 10 aa, Artificial Sequence
  Description of Artificial Sequence:  Synthetic Peptide
DDTRGRSAHF

SEQ ID NO: 8581 - protein, 9 aa, Artificial Sequence
  Description of Artificial Sequence:  Synthetic Peptide
KLRCGEFAV

SEQ ID NO: 8582 - protein, 9 aa, Artificial Sequence
  Description of Artificial Sequence:  Synthetic Peptide
KQIDMTSKL

SEQ ID NO: 8583 - protein, 9 aa, Artificial Sequence
  Description of Artificial Sequence:  Synthetic Peptide
RAEGGAPDK

SEQ ID NO: 8584 - protein, 9 aa, Artificial Sequence
  Description of Artificial Sequence:  Synthetic Peptide
KQIDMTSKL

SEQ ID NO: 8585 - protein, 9 aa, Artificial Sequence
  Description of Artificial Sequence:  Synthetic Peptide
RYMAGIDRT

SEQ ID NO: 8586 - protein, 10 aa, Artificial Sequence
  Description of Artificial Sequence:  Synthetic Peptide
RYMAGIDRTI

SEQ ID NO: 8587 - protein, 10 aa, Artificial Sequence
  Description of Artificial Sequence:  Synthetic Peptide
RSVQDGIGRL

SEQ ID NO: 8588 - protein, 9 aa, Artificial Sequence
  Description of Artificial Sequence:  Synthetic Peptide
PVAPGREGK

SEQ ID NO: 8589 - protein, 9 aa, Artificial Sequence
  Description of Artificial Sequence:  Synthetic Peptide
RSVQDGIGR

SEQ ID NO: 8590 - protein, 9 aa, Artificial Sequence
  Description of Artificial Sequence:  Synthetic Peptide
AQVPHVEGR

SEQ ID NO: 8591 - protein, 9 aa, Artificial Sequence
  Description of Artificial Sequence:  Synthetic Peptide
KQLTNKKDR

SEQ ID NO: 8592 - protein, 9 aa, Artificial Sequence
  Description of Artificial Sequence:  Synthetic Peptide
RLVHNTRVR

SEQ ID NO: 8593 - protein, 9 aa, Artificial Sequence
  Description of Artificial Sequence:  Synthetic Peptide
IIGDMVKPR

SEQ ID NO: 8594 - protein, 10 aa, Artificial Sequence
  Description of Artificial Sequence:  Synthetic Peptide
MTRYMAGIDR

SEQ ID NO: 8595 - protein, 10 aa, Artificial Sequence
  Description of Artificial Sequence:  Synthetic Peptide
VPGGHRGGHR

SEQ ID NO: 8596 - protein, 10 aa, Artificial Sequence
  Description of Artificial Sequence:  Synthetic Peptide
TLANARDTPR

SEQ ID NO: 8597 - protein, 10 aa, Artificial Sequence
  Description of Artificial Sequence:  Synthetic Peptide
KQIDMTSKLR

SEQ ID NO: 8598 - protein, 10 aa, Artificial Sequence
  Description of Artificial Sequence:  Synthetic Peptide
GIGRLVHNTR

SEQ ID NO: 8599 - protein, 10 aa, Artificial Sequence
  Description of Artificial Sequence:  Synthetic Peptide
AIIGDMVKPR

SEQ ID NO: 8600 - protein, 9 aa, Artificial Sequence
  Description of Artificial Sequence:  Synthetic Peptide
APGREGKQL

SEQ ID NO: 8601 - protein, 9 aa, Artificial Sequence
  Description of Artificial Sequence:  Synthetic Peptide
KPRGIAHLV

SEQ ID NO: 8602 - protein, 9 aa, Artificial Sequence
  Description of Artificial Sequence:  Synthetic Peptide
TPRSVQDGI

SEQ ID NO: 8603 - protein, 9 aa, Artificial Sequence
  Description of Artificial Sequence:  Synthetic Peptide
HPTPRGVTL

SEQ ID NO: 8604 - protein, 9 aa, Artificial Sequence
  Description of Artificial Sequence:  Synthetic Peptide
TSKLRCGEF

SEQ ID NO: 8605 - protein, 9 aa, Artificial Sequence
  Description of Artificial Sequence:  Synthetic Peptide
RVRAIIGDM

SEQ ID NO: 8606 - protein, 9 aa, Artificial Sequence
  Description of Artificial Sequence:  Synthetic Peptide
GAPDKQIDM

SEQ ID NO: 8607 - protein, 10 aa, Artificial Sequence
  Description of Artificial Sequence:  Synthetic Peptide
RSVQDGIGRL

SEQ ID NO: 8608 - protein, 10 aa, Artificial Sequence
  Description of Artificial Sequence:  Synthetic Peptide
AEGGAPDKQI

SEQ ID NO: 8609 - protein, 9 aa, Artificial Sequence
  Description of Artificial Sequence:  Synthetic Peptide
APGREGKQL

SEQ ID NO: 8610 - protein, 9 aa, Artificial Sequence
  Description of Artificial Sequence:  Synthetic Peptide
HPTPRGVTL

SEQ ID NO: 8611 - protein, 9 aa, Artificial Sequence
  Description of Artificial Sequence:  Synthetic Peptide
TPRSVQDGI

SEQ ID NO: 8612 - protein, 9 aa, Artificial Sequence
  Description of Artificial Sequence:  Synthetic Peptide
RVRAIIGDM

SEQ ID NO: 8613 - protein, 9 aa, Artificial Sequence
  Description of Artificial Sequence:  Synthetic Peptide
KPRGIAHLV

SEQ ID NO: 8614 - protein, 9 aa, Artificial Sequence
  Description of Artificial Sequence:  Synthetic Peptide
SVQDGIGRL

SEQ ID NO: 8615 - protein, 10 aa, Artificial Sequence
  Description of Artificial Sequence:  Synthetic Peptide
TPRGVTLANA

SEQ ID NO: 8616 - protein, 10 aa, Artificial Sequence
  Description of Artificial Sequence:  Synthetic Peptide
MVKPRGIAHL

SEQ ID NO: 8617 - protein, 10 aa, Artificial Sequence
  Description of Artificial Sequence:  Synthetic Peptide
AGIDRTIAVL

SEQ ID NO: 8618 - protein, 10 aa, Artificial Sequence
  Description of Artificial Sequence:  Synthetic Peptide
VAPGREGKQL

SEQ ID NO: 8619 - protein, 10 aa, Artificial Sequence
  Description of Artificial Sequence:  Synthetic Peptide
RVRAIIGDMV

SEQ ID NO: 8620 - protein, 9 aa, Artificial Sequence
  Description of Artificial Sequence:  Synthetic Peptide
HPTPRGVTL

SEQ ID NO: 8621 - protein, 10 aa, Artificial Sequence
  Description of Artificial Sequence:  Synthetic Peptide
TNKKDRPAQV

The invention claimed is:

1. An isolated polypeptide encoded by an alternative reading frame of an influenza virus, wherein said polypeptide comprises the sequence VTILNLALL (SEQ ID NO: 1042) and starts with a methionine amino acid residue, or a fragment of said polypeptide comprising the sequence VTILNLALL (SEQ ID NO: 1042).

2. The polypeptide or fragment of claim 1, further defined as comprising at least one cytotoxic T lymphocyte (CTL-) epitope.

3. The polypeptide or fragment of claim 1, wherein the CTL-epitope is further defined as an HLA allele.

4. The polypeptide or fragment of claim 3, wherein the HLA allele is an A0201, A1, A24, A3, A31, B3501, B4403, B7, or B8 allele.

5. The polypeptide or fragment of claim 4, where in the HLA allele is an A0201 allele.

6. The polypeptide or fragment of claim 1, further defined as comprising at least one T helper cell epitope.

7. The polypeptide or fragment of claim 6, wherein the T helper cell epitope is for an HLA allele, the HLA allele further defined as DP, DQ, or DR.

8. The polypeptide or fragment of claim 1, further defined as a polypeptide comprising a fragment with a score of 50 or more.

9. The polypeptide or fragment of claim 8, further defined as a polypeptide comprising a fragment with a score of more than 200.

10. The polypeptide or fragment of claim 9, further defined as a polypeptide comprising a fragment with a score of more than 500.

11. The polypeptide or fragment of claim 1, further defined as conjugated to a carrier.

12. The polypeptide or fragment of claim 11, wherein the carrier is defined as a immunomodulating substance.

13. The polypeptide or fragment of claim 12, wherein the immunomodulating substance is a polycationic substance.

14. The polypeptide or fragment of claim 13, wherein the polycationic substance is a polycationic polypeptide.

15. The polypeptide or fragment of claim 12, wherein the immunomodulating substance is an immunomodulating nucleic acid.

16. The polypeptide or fragment of claim 15, wherein the immunomodulating nucleic acid is a deoxyinosine- and/or deoxyuridine containing oligodeoxynucleotide.

17. The polypeptide or fragment of claim 1, further defined as comprising at least one T cell epitope.

18. The polypeptide or fragment of claim 1, further defined as encoded by an alternative reading frame which reads on the complementary strand as the functional reading frame of said influenza virus.

19. The polypeptide or fragment of claim 1, further defined as comprising a tail consisting of two to seven amino acids, the amino acids defined as selected from F, I, L, A, Y, W or C, at at least one of its N- or C-terminus.

20. The polypeptide or fragment of claim 1, further defined as comprising a tail consisting of two to seven amino acids, the amino acids defined as selected from E or D, at at least one of its N- or C-terminus.

21. The polypeptide or fragment of claim 20, further defined as comprised in a pharmaceutical composition.

22. A pharmaceutical composition comprising one or more polypeptide encoded by an alternative reading frame of an influenza virus, wherein said polypeptide comprises the sequence VTILNLALL (SEQ ID NO: 1042) and starts with a methionine amino acid residue, or a fragment of said polypeptide comprising the sequence VTILNLALL (SEQ ID NO: 1042).

23. The pharmaceutical composition of 22, further defined as comprising an immunomodulating substance.

24. The pharmaceutical composition of claim 23, wherein the immunomodulating substance is a polycationic substance.

25. The pharmaceutical composition of claim 24, wherein the polycationic substance is a polycationic polypeptide.

26. The pharmaceutical composition of claim 23, wherein the immunomodulating substance is an immunomodulating nucleic acid.

27. The pharmaceutical composition of claim 26, wherein the immunomodulating nucleic acid is a deoxyinosine- and/or deoxyuridine containing oligodeoxynucleotide.

28. The pharmaceutical composition of claim 22, further defined as comprising a structural or functional polypeptide of an influenza virus or a fragment thereof.

29. The pharmaceutical composition of claim 28, further defined as comprising an antigenic determinant.

30. The pharmaceutical composition of claim 22, further defined as comprising, per administerable dose, 1 ng to 1 g of one or more polypeptide encoded by an alternative reading frame of an influenza virus, wherein said polypeptide comprises the sequence VTILNLALL (SEQ ID NO: 1042) and starts with a methionine amino acid residue, or a fragment of said polypeptide comprising the sequence VTILNLALL (SEQ ID NO: 1042).

31. The pharmaceutical composition of claim 30, further defined as comprising, per administerable dose, 100 ng to 10 mg of the one or more polypeptide encoded by an alternative reading frame of an influenza virus or fragment thereof.

32. The pharmaceutical composition of claim 31, further defined as comprising, per administerable dose, 10 μg to 1 mg of the one or more polypeptide encoded by an alternative reading frame of an influenza virus or fragment thereof.

33. The pharmaceutical composition of claim 22, further defined as a vaccine.

34. The pharmaceutical composition of claim 22, further defined as comprising at least one immunopotentiating cytokine, anti-inflammatory substance, or antimicrobial substance.

35. The pharmaceutical composition of claim 22, further defined as comprising a polycationic polymer.

36. The pharmaceutical composition of claim 35, wherein the polycationic polymer is further defined as a polycationic polypeptide further defined as polyarginine or polylysine.

37. The pharmaceutical composition of claim 22, further defined as comprising an antimicrobial peptide.

38. The pharmaceutical composition of claim 37, wherein the antimicrobial peptide is further defined as a cathelicidin-derived antimicrobial peptide.

39. The pharmaceutical composition of claim 22, further defined as comprising a growth hormone.

40. The pharmaceutical composition of claim 39, wherein the growth hormone is further defined as a human growth hormone.

41. The pharmaceutical composition of claim 22, further defined as comprising at least one pharmaceutically acceptable carrier, buffer substance, or stabilizer.

* * * * *

UNITED STATES PATENT AND TRADEMARK OFFICE
CERTIFICATE OF CORRECTION

| | |
|---|---|
| PATENT NO. | : 7,528,223 B2 |
| APPLICATION NO. | : 10/512790 |
| DATED | : May 5, 2009 |
| INVENTOR(S) | : Frank Mattner et al. |

It is certified that error appears in the above-identified patent and that said Letters Patent is hereby corrected as shown below:

On title page, item (56) References Cited - U.S. Patent Documents, insert --5,683,864    11/97   Houghton et al. ...... 435/5--.

Signed and Sealed this

Fourteenth Day of July, 2009

JOHN DOLL
*Acting Director of the United States Patent and Trademark Office*